US007157621B2

(12) United States Patent
Allen et al.

(10) Patent No.: US 7,157,621 B2
(45) Date of Patent: Jan. 2, 2007

(54) ALTERATION OF OIL TRAITS IN PLANTS

(75) Inventors: Stephen M. Allen, Wilmington, DE (US); William B. Allen, Urbandale, IA (US); Rebecca E. Cahoon, Webster Groves, MO (US); Sabine Epelbaum, Wilimington, DE (US); Omolayo O. Famodu, Newark, DE (US); Leslie T. Harvell, Newark, DE (US); Todd J. Jones, Kent, WA (US); Anthony J. Kinney, Wilimington, DE (US); Theodore M. Klein, Wilimington, DE (US); Changjiang Li, Urbandale, IA (US); Igor Cunha Oliveira, Urbandale, IA (US); Hajime Sakai, Newark, DE (US); Bo Shen, Johnston, IA (US); Mitchell C. Tarczynski, West Des Moines, IA (US)

(73) Assignees: E. I. du Pont de Nemours and Company, Wilmington, DE (US); Pioneer Hi-Bred International, Inc., Johnston, IA (US)

( * ) Notice: Subject to any disclaimer, the term of this patent is extended or adjusted under 35 U.S.C. 154(b) by 285 days.

(21) Appl. No.: 10/183,687

(22) Filed: Jun. 27, 2002

(65) Prior Publication Data
US 2003/0204870 A1 Oct. 30, 2003

Related U.S. Application Data

(60) Provisional application No. 60/301,913, filed on Jun. 29, 2001.

(51) Int. Cl.
*A01H 5/00* (2006.01)
*C12N 15/82* (2006.01)
(52) U.S. Cl. ..................... 800/298; 800/281; 536/23.2
(58) Field of Classification Search ............... 536/23.6; 800/281, 298
See application file for complete search history.

(56) References Cited
U.S. PATENT DOCUMENTS

| 5,004,863 | A | 4/1991 | Umbeck |
| 5,159,135 | A | 10/1992 | Umbeck |
| 5,416,011 | A | 5/1995 | Hinchee et al. |
| 5,463,174 | A | 10/1995 | Moloney et al. |
| 5,518,908 | A | 5/1996 | Corbin et al. |
| 5,569,834 | A | 10/1996 | Hinchee et al. |
| 5,631,152 | A | 5/1997 | Fry et al. |

FOREIGN PATENT DOCUMENTS

| EP | 0 301 749 | 2/1989 |
| WO | WO 98/46776 A | 10/1998 |
| WO | WO 99/67405 | 12/1999 |
| WO | WO 00/00619 | 1/2000 |
| WO | WO 00/04761 | 2/2000 |
| WO | WO 00/28058 | 5/2000 |

OTHER PUBLICATIONS

Doerks et al. TIG 14(6): 248-250, Jun. 1998.*
Smith et al, Nature Biotechnology 15: 1222-1223, Nov. 15, 1997.*
Brenner, S.E., TIG 15(4): 132-133, Apr. 1999.*
Bork et al, TIG 12(10): 425-427, Oct. 1996.*
Paula P. Chee et al., Transformation of Soybean (*Glycine max*) by infecting Germinating Seeds with *Agrobacterium tumefaciens*, Plant Phys., vol. 91:1212-1218, Jun. 12, 1989.
Maud A. W. Hinchee et al., Production of Transgenic Soybean plants using *Agrobacterium*-Mediated DNA Transfer, Bio/Technology, vol. 6:915-922, Aug. 1988.
Marc De Block et al., Transformation of *Brassica napus* and *Brassica oleracea* Using *Agrobacterium tumefaciens* and the Expression of the bar and neo Genes in the Transgenic Plants, Plant Phys., vol. 91:694-701, Apr. 3, 1989.
N. P. Everett et al., Genetic Engineering of Sunflower (*Helianthus annuus* L.), Bio/Technology, vol. 5:1201-1204, 1987.
S. D. Tanksley et al., RFLP Mapping in Plant Breeding; New Tools for an Old Science, Bio/Technology, vol. 7:257-264, Mar. 1989.
David Edwards et al., Multiple Genes Encoding the Conserved CCAAT-Box Transcription Factor Complex Are Expressed in *Arabidopsis*, Plant Phys., vol. 117:1015-1022, 1998.
Minou Nowrousian et al., Cell Differentiation during Sexual Development of the Fungus *Sordaria macrospora* Requires ATP Citrate Lyase Activity, Molecular and Cellular Biology, vol. 19(1):450-460, Jan. 1999.
David M. Braun et al., Plant transmembrane receptors: new pieces in the signaling puzzle, Trends Biochem., 21:70-73, 1996.
Xiaoquan Wang et al., The PR5K receptor protein kinase from *Arabidopsis thaliana* is structurally related to a family of plant defense proteins, PNAS, vol. 93:2598-2602, Mar. 1996.
John C. Walker, Structure and function of the receptor-like protein kinases of higher plants, Plant Molecular Biology, vol. 26:1599-1609, 1994.
Thomas M. Wahlund et al., The Reductive Tricarboxylic Acid Cycle of Carbon Dioxide Assimilation: Initial Studies and Purification of ATP-Citrate Lyase from the Green Sulfur Bacterium *Chlorobium tepidum*, Journal of Bacteriology, vol. 179(15):4859-4867, Aug. 1997.
Paula A. Srere, The Citrate Cleavage Enzyme, Journ. of Biol. Chem., vol. 234(10):2544-2547, Oct. 1959.
A. Guerritore et al., Presence and Adaptive Changes of Citrate Ezyme in the Yeast *Rhodotorula gracilis*, Experientia, vol. 26:28-30, 1970.
Oliver H. Lowry et al., Protein Measurement with the Folin Phenol Reagent, J. Biol. Chem., vol. 193:265-275, 1951.

(Continued)

Primary Examiner—Elizabeth F. McElwain
(74) Attorney, Agent, or Firm—E. T. du Pont de Nemours and Company; Kathryn K. Lappegard

(57) ABSTRACT

The preparation and use of nucleic acid fragments useful in altering the oil phenotype in plants are disclosed. Chimeric construct incorporating such nucleic acid fragments and suitable regulatory sequences can be used to create transgenic plants having altered lipid profiles. Methods for altering the oil phenotype in plants using such nucleic acid fragments also are disclosed.

7 Claims, 2 Drawing Sheets

OTHER PUBLICATIONS

Figure 1:
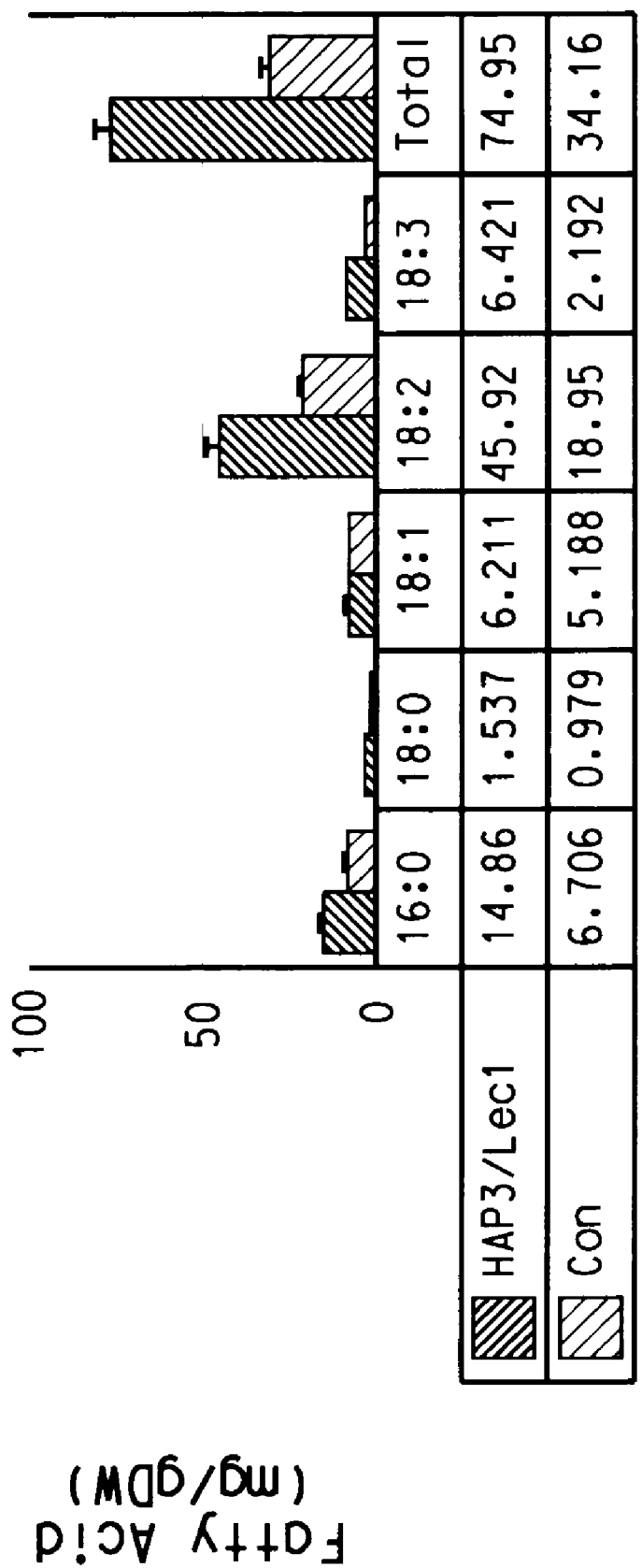

Hansjorg Fritsch et al., ATP Citrate Lyase from Germinating Castor Bean Endosperm, Plant Phys., vol. 63:687-691, 1979.

Changguo Chen et al., Some Enzymes and Properties of the Reductive Carboxylic Acid Cycle Are Present in the Green Alga *Chlamydomonas reinhardtli* F-60, Plant Phys., vol. 98:535-539, Jun. 27, 1991.

Dhandapani Rangasamy et al., Compartmentation of ATP:Citrate Lyase in Plants, Plant Phys., vol. 122:1225-1230, Apr. 2000.

Colin Ratledge et al., Correlation of ATP/Citrate Lyase Activity with Lipid Accumulation in Developing Seeds of *Brassica napus* L., Lipids, vol. 32(1):7-12, 1997.

Christopher Thomas Evans et al., The Physiological Significance of Citric Acid in the Control of Metabolism in Lipid-Accumulation Yeasts, Biotechnology and Genetic Engineering Reviews, vol. 3:349-375, 1985.

Dhandapani Rangasamy et al., Genetic Enhancement of Fatty Acid Synthesis by Targeting Rat Liver ATP:Citrate Lyase into Plastids of Tobacco, Plant Physiology, vol. 122:1231-1238, Apr. 2000.

Henrik Naested et al., Caleosins: Ca2+-binding proteins associated with lipid bodies, Plant Molecular Biology, vol. 44:463-476, 2000.

Mitsuhiko Ikura, Calcium binding and conformational response in EF-hand proteins, Trends in Biochem. Science, vol. 21:14-17, 1996.

Ping Lin et al., The Mammalian Calcium-binding Protein, Nucleobindin (CALNUC), Is a Golgi Resident Protein, Journal of Cell Biology, vol. 141(7):1515-1527, Jun. 29, 1998.

Gitte Frandsen et al., Novel Plant Ca2+-binding Protein Expression in Response to Abscisic Acid and Osmotic Stress, Journ. of Biological Chem., vol. 271(1):343-348, Jan. 5, 1996.

Emily C.F. Chen et al., Identification of Three Novel Unique Proteins in Seed Oil bodies of Sesame, Plant Cell Phys., vol. 39(9):935-941, 1998.

Micheal L. Nuccio et al., ATS1 and ATS3: two novel embryo-specific genes in *Arabidopsis thaliana*, Plant Molecular Biology, vol. 39:1153-1163, 1999.

Dennis E. McCabe et al., Stable Transformation of Soybean (*Glycine max*) by particle Acceleration, Bio/Technology, vol. 6:923-926, Aug. 1988.

Paul Christou et al., Stable Transformation of Soybean Callus by DNA-Coated Gold Particles, Plant Phys., vol. 87:671-674, 1988.

Ming Cheng et al., Production of fertile transgenic peanut (*Arachis hypogaea* L.) plants using *Agrobacterium tumefaciens*, Plant Cell Reports, vol. 15:653-657, 1996.

A. H. McKently et al., *Agrobacterium*-mediated transformation of peanut (*Arachis hypogaea* L.) embryo axes and the development of transgenic plants, Plant Cell Reports, vol. 14:699-703, 1995.

Jan E. Grant et al., Transformation of peas (*Pisum sativum* L.) using immature cotyledons, Plant Cell Reports, vol. 15:254-258, 1995.

Benny Bytebier et al., T-DNA organization in tumor cultures and transgenic plants of the monocotyledon *Asparagus officinalis*, PNAS, vol. 84:5345-5349, Aug. 1987.

Yuechun Wan et al., Generation of Large Numbers of Independently Transformed Fertile Barley Plants, Plant Phys., vol. 104:37-48, 1994.

Carol A. Rhodes et al., Genetically Transformed Maize Plants from Protoplasts, Science, vol. 240:204-207, Apr. 8, 1988.

William J. Gordon-Kamm et al., Transformation of Maize Cells and Regeneration of Fertile Transgenic Plants, The Plant Cell, vol. 2:603-618, Jul. 1990.

Micheal E. Fromm et al., inheritance and Expression of Chimeric Genes in the Progeny of Transgenic Maize Plants, Bio/Technology, vol. 8:833-839, Sep. 1990.

Michael G. Koziel et al., Field Performance of Elite Transgenic Maize Plants Expressing an Insecticidal Protein Derived from *Bacillus thruingiensis*, Bio/Technology, vol. 11:194-199, Feb. 11, 1993.

Charles L. Armstrong et al., Field Evaluation of European Corn Borer Control in Progeny of 173 Transgenic Corn Events Expression an Insecticidal Protein from *Bacillus thuringiensis*, Crop Science, vol. 35:550-557, 1995.

David A. Somers et al., Fertile, Transgenic Oat Plants, Bio/Technology, vol. 10:1589-1594, Dec. 1992.

M. E. Horn et al., Transgenic plants of Orchardgrass (*Dactylis glomerata* L.) from protoplasts, Plant Cell Reports, vol. 7:469-472, 1988.

Kinya Toriyama et al., Haploid and diploid plant regeneration from protoplasts of *Anther callus* in rice, Theor. Appl. Genet., vol. 73:16-19, 1986.

Sung Hun Park et al., T-DNA integration into genomic DNA of rice following *Agrobacterium* inoculation of isolated shoot apices, Plant Molecular Biology, vol. 32:1135-1148, 1996.

M. Abedinia et al., An Efficient Transformation System for the Australian Rice Cultivar, Jarrah, Aus. J. Plant Phys., vol. 24:133-141, 1997.

W. Zhang et al., Efficient regeneration of transgenic plants from rice protoplasts and correctly regulated expression of the foreign gene is the plants, theor. Appl. Genet., vol. 76:835-840, 1988.

H. M. Zhang et al., Transgenic rice plants produced by electroporation-mediated plasmid uptake into protoplasts, Plant Cell Reports, vol. 7:379-384, 1988.

M. Battraw et al., Expression of a chimeric neomycin phosphotransferase II gene in first and second generation transgenic rice plants, Plant Science, vol. 86:191-202, 1992.

Paul Christou et al., Production of Transgenic Rice (*Oryza sativa* L.) Plants from Agronomically Important Indica and Japonica Varieties Via Electric Discharge Particle Acceleration of Exogenous DNA Into Immature Zygotic Embryos, Bio/Technology, vol. 9:957-962, Oct. 1991.

A. De La Pena et al., Transgenic rye plants obtained by injecting DNA into young floral tillers, Nature, vol. 325:274-276, Jan. 15, 1987.

Robert Bower et al., Transgenic sugarcane plants via microprojectile bombardment, The Plant Journal, vol. 2(3):409-416, 1992.

Zeng-yu Wang et al., Transgenic Plants of Tall Fescue (*Frestuca arundinacea* Schreb.) obtained by direct Gene Transfer to Protoplasts, Bio/Technology, vol. 10:691-696, Jun. 1992.

Vimla Vasil et al., Herbicide Resistant Fertile Transgenic Wheat Plants Obtained by Microprojectile Bombardment of Regenerable Embryogenic Callus, Bio/Technology, vol. 10:667-674, Jun. 1992.

William R. Marcotte, Jr. et al., Regulation of a Wheat Promoter by Abscisic Acid in Rice Protoplasts, Nature, vol. 335:454-457, Sep. 29, 1988.

Donald R. McCarty et al., Molecular Analysis of vivparous-1: an Abscisic Acid-Insensitive Mutant of Maize, The Plant Cell, vol. 1:523-532, May 1989.

Donald R. McCarty et al., The Viviparous-1 Developmental Gene of Maize Encodes a Novel Transcriptional Activator, Cell, vol. 66:895-905, Sep. 6, 1991.

Tsukaho Hattori et al., The Viviparous-1 gene and abscisic acid activate the C1 regulatory gene for anthocyanin biosynthsis during seed maturation in maize, Genes & Development, vol. 6:609-618, 1992.

Stephen A. Goff et al., Transactivation of anthocyanin biosynthetic genes following transfer of B regulatory genes into maize tissues, The EMBO Journal, vol. 9(8):2517-2522, 1990.

National Center For Biotechnology Information General Indentifier No. 1171429, Accession No. AAA86281, P. Vergani et al., Han. 30, 1998.

Paul Christou et al., Inheritance and expression of foreign genes in transgenic soybean plants, Proc. Natl. Acad. Scie USA, vol. 86:7500-7504, 1989.

X. Zhang, Leucine-rich repeat receptor-kinases in plants, Plant Molecular Biology Reporter, vol. 16:301-311, 1998.

Jaqueline H. A. Barker et al., Evidence that barley 3-hydroxy-3-methylglutaryl-coenzyme A reductase kinase is a member of the sucrose nonfermenting-1-related protein kinase family, Plant Phys., vol. 112(3):1141-1149, 1996.

\* cited by examiner

ALTERATION OF OIL TRAITS IN PLANTS

This application claims the priority benefit of U.S. Provisional Application 60/301,913 filed Jun. 29, 2001, the disclosure of which is hereby incorporated by reference in its entirety.

FIELD OF THE INVENTION

The present invention is in the field of plant breeding and genetics and, in particular, relates to the alteration of oil phenotype in plants through the controlled expression of selective genes.

BACKGROUND OF THE INVENTION

Plant lipids have a variety of industrial and nutritional uses and are central to plant membrane function and climatic adaptation. These lipids represent a vast array of chemical structures, and these structures determine the physiological and industrial properties of the lipid. Many of these structures result either directly or indirectly from metabolic processes that alter the degree of unsaturation of the lipid. Different metabolic regimes in different plants produce these altered lipids, and either domestication of exotic plant species or modification of agronomically adapted species is usually required to produce economically large amounts of the desired lipid.

There are serious limitations to using mutagenesis to alter fatty acid composition. Screens will rarely uncover mutations that a) result in a dominant ("gain-of-function") phenotype, b) are in genes that are essential for plant growth, and c) are in an enzyme that is not rate-limiting and that is encoded by more than one gene. In cases where desired phenotypes are available in mutant corn lines, their introgression into elite lines by traditional breeding techniques is slow and expensive, since the desired oil compositions are likely the result of several recessive genes.

Recent molecular and cellular biology techniques offer the potential for overcoming some of the limitations of the mutagenesis approach, including the need for extensive breeding. Some of the particularly useful technologies are seed-specific expression of foreign genes in transgenic plants [see Goldberg et al (1989) *Cell* 56:149–160], and the use of antisense RNA to inhibit plant target genes in a dominant and tissue-specific manner [see van der Krol et al (1988) *Gene* 72:45–50]. Other advances include the transfer of foreign genes into elite commercial varieties of commercial oilcrops, such as soybean [Chee et al (1989) *Plant Physiol.* 91:1212–1218; Christou et al (1989) *Proc. Natl. Acad. Sci. U.S.A.* 86:7500–7504; Hinchee et al (1988) *Bio/Technology* 6:915–922; EPO publication 0 301 749 A2], rapeseed [De Block et al (1989) *Plant Physiol.* 91:694–701], and sunflower [Everett et al(1987) *Bio/Technology* 5:1201–1204], and the use of genes as restriction fragment length polymorphism (RFLP) markers in a breeding program, which makes introgression of recessive traits into elite lines rapid and less expensive [Tanksley et al (1989) *Bio/Technology* 7:257–264]. However, application of each of these technologies requires identification and isolation of commercially-important genes.

The regulation of transcription of most eukaryotic genes is coordinated through sequence-specific binding of proteins to the promoter region located upstream of the gene. Many of these protein-binding sequences have been conserved during evolution and are found in a wide variety of organisms. One such feature is the "CCAAT" sequence element. (Edwards et al, 1998, *Plant Physiol.* 117:1015–1022). CCAAT boxes are a feature of gene promoters in many eukaryotes including several plant gene promoters.

HAP proteins constitute a large family of transcription factors first identified in yeast. They combine to from a heteromeric protein complex that activates transcription by binding to CCAAT boxes in eukaryotic promoters. The orthologous Hap proteins display a high degree of evolutionary conservation in their functional domains in all species studied to date (Li et al, 1991).

WO 00/28058 published on May 18, 2000 describes Hap3-type CCAAT-box binding transcriptional activator polynucleotides and polypeptides, especially, the leafy cotyledon 1 transcriptional activator (LEC1) polynucleotides and polypeptides.

WO 99/67405 describes leafy cotyledons genes and their uses.

The human, murine and plant homologues of CCAAT-binding proteins have been isolated and characterized based on their sequence similarity with their yeast counterparts (Li et al, 1991). This high degree of sequence homology translates remarkably into functional interchangeability among orthologue proteins of different species (Sinha et al, 1995). Unlike yeast, multiple forms of each HAP homolog have been identified in plants (Edwards et al, 1998).

Molecular and genetic analysis revealed HAP members to be involved in the control of diverse and critical biological processes ranging from development and cell cycle regulation to metabolic control and homeostasis (Lotan et al, 1998; Lopez et al, 1996). In yeast, HAPs are involved in the transcriptional control of metabolic relevant processes such as the regulation of catabolic derepression of cyc1 and other genes involved in respiration (Becker et al., 1991).

In mammalian systems, several reports describe HAPs as direct or indirect regulators of several important genes involved in lipid biosynthesis such as fatty acid synthase (Roder et al, 1997), farnesyl diphosphate (FPP) synthase (Jackson et al, 1995; Ericsson et al, 1996), glycerol-3-phosphate acyltransferase (GPA, Jackson et al, 1997), acetyl-CoA carboxylase (ACC, Lopez et al, 1996) and 3-hydroxy-3-methylglutaryl-coenzyme A (HMG-CoA) synthase (Jackson et al, 1995), among others.

In addition, other CCAAT-binding transcription factors have also been reported to be involved in different aspects of the control of lipid biosynthesis and adipocyte growth and differentiation in mammalian systems (see McKnight et al, 1989).

It appears that the currently available evidence to date points to a family of proteins of the CCAAT-binding transcription factors as important modulators of metabolism and lipid biosynthesis in mammalian systems. Such a determination has not been made for plant systems.

SUMMARY OF THE INVENTION

This invention concerns an isolated nucleotide fragment comprising a nucleic acid sequence selected from the group consisting of:

(a) a nucleic acid sequence encoding a first polypeptide having receptor-like protein kinase activity, the first polypeptide having at least 85% identity based on the Clustal method of alignment when compared to a second polypeptide selected from the group consisting of SEQ ID NOs: 2 or 4;

(b) a nucleic acid sequence encoding a third polypeptide having MAP kinase-kinase-kinase activity, the third polypeptide having at least 70% identity based on the Clustal method of alignment when compared to a fourth polypeptide selected from the group consisting of SEQ ID NOs: 6, 8,10,12, 14, 16, 493, 495, or 497;

(c) a nucleic acid sequence encoding a fifth polypeptide having Hap2-like transcription factor activity, the fifth polypeptide having at least 70% identity based on the Clustal method of alignment when compared to a sixth polypeptide selected from the group consisting of SEQ ID NOs: 18, 20, 22, 26, 28, 30, 32, 34, 36, 38, 40, 42, 44, 46, 48, 50, 52, 54, 56, 58, 62, 64, 66, 68, 70, 72, 74, 76, 78, 80, 82, 84, 86, 88, 90, 92, 94, 96, 98, 461, 463, 465, 467, or 469;

(d) a nucleic acid sequence encoding a seventh polypeptide having Hap5-like transcription factor activity, the seventh polypeptide having at least 80% identity based on the Clustal method of alignment when compared to an eighth polypeptide selected from the group consisting of SEQ ID NOs: 100, 102, 104, 106, 108, 110, 112, 114, 116, 118, 120, 122, 124, 126, 128, 130, 132, 134, 136, 138, 140, 142, or 144, or 474;

(e) a nucleic acid sequence encoding a ninth polypeptide having LIP15-like transcription factor activity, the ninth polypeptide having at least 85% identity based on the Clustal method of alignment when compared to a tenth polypeptide selected from the group consisting of SEQ ID NOs: 148, 152, or 154;

(f) a nucleic acid sequence encoding an eleventh polypeptide caleosin-like activity, the eleventh polypeptide having at least 70% identity based on the Clustal method of alignment when compared to a twelfth polypeptide selected from the group consisting of SEQ ID NOs: 158, 160, 162, 164, 166, 168, 170, 172, 174, 176, 178, 180, 182, 184, 186, 188, 190, 192, 194, 196, 198, 499, 501, 503, 505, 507, 509, 511, 513, 515, 517, 519, 521, 523, 525, or 527; or (g) a nucleic acid sequence encoding a thirteenth polypeptide having ATP citrate lyase activity, the thirteenth polypeptide having at least 94% identity based on the Clustal method of alignment when compared to a fourteenth polypeptide selected from the group consisting of SEQ ID NOs: 200, 202, 204, 206, 208, 210, 212, 214, 216, 218, 220, 222, 224, 226, 228, 230, or232;

(h) a nucleic acid sequence encoding a fifteenth polypeptide having SNF1-like activity, the fifteenth polypeptide having at least 90% identity based on the Clustal method of alignment when compared to a sixteenth polypeptide selected from the group consisting of SEQ ID NOs: 244, 256, or 258;

(i) a nucleic acid sequence encoding a seventeenth polypeptide having Hap3/Lec1-like activity, the seventeenth polypeptide having at least 70% identity based on the Clustal method of alignment when compared to a eighteenth polypeptide selected from the group consisting of SEQ ID NOs: 260, 262, 264, or 266;

(j) a nucleic acid sequence encoding a nineteenth polypeptide having CKC-like transcription factor activity, the nineteenth polypeptide having at least 88% identity based on the Clustal method of alignment when compared to an twentieth polypeptide selected from the group consisting of SEQ ID NOs: 310, 312, 316, 318, 320, 328, 330, 332, 338, 342, 344, 348, 352, 354, 358, 362, 477, 479, 481, 483, 485, 487, 489, or 491.

Also of interest are the complements of such nucleotide fragment as well as the use of such fragments or a part thereof in antisense inhibition or co-suppression in a transformed plant.

In a second embodiment, this invention concerns chimeric constructs comprising such fragments, plants comprising such chimeric genes in their genome, seeds obtained from such plants and oil obtained from these seeds.

In a third embodiment, this invention concerns a method for altering oil phenotype in a plant which comprises:

(a) transforming a plant with a chimeric construct the invention, (b) growing the transformed plant under conditions suitable for expression of the chimeric gene; and (c) selecting those transformed plants whose oil phenotype has been altered compared to the oil phenotype of an untransformed plant.

In a fourth embodiment, this invention concerns a method for altering oil phenotype in a plant which comprises:

(a) transforming a plant with a chimeric construct comprising isolated nucleotide fragment comprising a nucleic acid sequence selected from the group consisting of:

(i) a nucleic acid sequence encoding a plant SNF1 protein kinase having at least 60% identity based on the Clustal method of alignment when compared to a second polypeptide selected from the group consisting of even SEQ ID NOs: from 234 to 258 and SEQ ID NOs: 400–409;

(ii) the complement of the nucleic acid sequence of (i);

(iii) the sequence of (i) or (ii) or a part thereof which is useful in antisense inhibition or co-suppression in a transformed plant;

(iv) a nucleic acid sequence encoding a plant Hap3/Lec1 transcription factor having at least 60% identity based on the Clustal method of alignment when compared to a second polypeptide selected from the group consisting of even SEQ ID NOs: from 260 to 278, and SEQ ID NOs: 411 and 412;

(v) the complement of the nucleic acid sequence of (iv);

(vi) the sequence of (iv) or (v) or a part thereof which is useful in antisense inhibition or co-suppression in a transformed plant;

(vii) a nucleic acid sequence encoding a plant Lec1-related CCAAT binding transcription factor having at least 60% identity based on the Clustal method of alignment when compared to a second polypeptide selected from the group consisting of even SEQ ID NOs: from 280 to 308, and SEQ ID NOs: 413–418;

(viii) the complement of the nucleic acid sequence of (vii);

(ix) the sequence of (vii) or (viii) or a part thereof which is useful in antisense inhibition or co-suppression in a transformed plant;

(x) a nucleic acid sequence encoding a plant Aintegumenta-like transcription factor having at least 60% identity based on the Clustal method of alignment when compared to a second polypeptide selected from the group consisting of even SEQ ID NOs: from 310 to 364, and SEQ ID NOs: 419–429;

(xi) the complement of the nucleic acid sequence of (x);

(xii) the sequence of (x) or (xi) or a part thereof which is useful in antisense inhibition or co-suppression in a transformed plant;

wherein said nucleic acid sequence is operably linked to at least one regulatory sequence;

(b) growing the transformed plant under conditions suitable for expression of the chimeric gene; and (c) selecting those transformed plants whose oil phenotype has been altered compared to the oil phenotype of an untransformed plant.

In a fifth embodiment, this invention concerns a method for altering oil phenotype in a plant which comprises:

(a) transforming a plant with a chimeric construct comprising an isolated nucleic acid fragment operably linked to at least one regulatory sequence wherein said fragment has a nucleic acid sequence encoding a polypeptide having a sequence identity of at least 60% based on the Clustal method of alignment when compared to a polypeptide selected from the group consisting of even SEQ ID NOs: from 2 to 364, and SEQ ID NOs: 365–429 and 528–532, and all odd SEQ ID NOs: from 477 to 527;

(b) growing the transformed plant under conditions suitable for expression of the chimeric gene; and (c) selecting those transformed plants whose oil phenotype has been altered compared to the oil phenotype of an untransformed plant.

In a sixth embodiment, this invention concerns method of mapping genetic variations related to altered oil phenotypes in a plant comprising:

(a) crossing two plant varieties; and (b) evaluating genetic variations with respect to nucleic acid sequences set forth in the odd SEQ ID NOs: from 1 to 363, and in even SEQ ID NOs: from 476 to 526, in progeny plants resulting from the cross of step (a) wherein the evaluation is made using a method selected from the group consisting of: RFLP analysis, SNP analysis, and PCR-based analysis.

In a seventh embodiment, this invention concerns a method of molecular breeding to obtain altered oil phenotypes in a plant comprising:

(a) crossing two plant varieties; and (b) evaluating genetic variations with respect to nucleic acid sequences set forth in the odd SEQ ID NOs: from 1 to 363, and in even SEQ ID NOs: from 476 to 526, in progeny plants resulting from the cross of step (a) wherein the evaluation is made using a method selected from the group consisting of: RFLP analysis, SNP analysis, and PCR-based analysis.

In an eighth embodiment, this invention concerns a method for altering oil phenotype in a plant which comprises:

(a) transforming a plant with a chimeric construct comprising isolated nucleotide fragment comprising a nucleic acid sequence selected from the group consisting of:

(i) a nucleic acid sequence encoding a plant Hap3/Lec1 transcription factor having at least 70% identity based on the Clustal method of alignment when compared to a second polypeptide selected from the group consisting of SEQ ID NOs:260, 262, 264, 268, 270, 272, 274, 276, 278, 411, 412. or 459;

(ii) the complement of the nucleic acid sequence of (iv);

(iii) the sequence of (iv) or (v) or a part thereof which is useful in antisense inhibition or co-suppression in a transformed plant;

(b) growing the transformed plant under conditions suitable for expression of the chimeric gene; and (c) selecting those transformed plants whose oil phenotype has been altered compared to the oil phenotype of an untransformed plant.

In a ninth embodiment, this invention concerns a method to isolate nucleic acid fragments associated with altering oil phenotype in a plant which comprises:

(a) comparing even SEQ ID NOs: from 2 to 364, and SEQ ID NOs: 365–429 and 528–532, and all odd SEQ ID NOs: from 477 to 527 with other polypeptide sequences for the purpose of identifying polypeptides associated with altering oil phenotype in a plant;

(b) identifying the conserved sequences(s) or 4 or more amino acids obtained in step (a);

(c) making region-specific nucleotide probe(s) or oligomer(s) based on the conserved sequences identified in step (b); and (d) using the nucleotide probe(s) or oligomer(s) of step (c) to isolate sequences associated with altering oil phenotype by sequence dependent protocols.

BRIEF DESCRIPTION OF THE FIGURES AND SEQUENCE LISTINGS

The invention can be more fully understood from the following detailed description and the accompanying drawings and Sequence Listing which form a part of this application.

FIG. 1 shows the fatty acid composition of maize somatic embryos over-expressing Hap3/Lec1 (solid bars, "Hap3/Lec1") compared to control embryos (striped bars, "con"). A ubiquitin promoter was used to drive Hap3/Lec1 expression in maize embryogenic callus. More than ten different events were analyzed by GC for fatty acid content/composition and compared to controls transformed with the selectable marker (BAR gene) plasmid alone. The somatic embryos over-expressing Lec1 contain elevated fatty acid contents averaging 119% over control oil levels.

Figure 2:
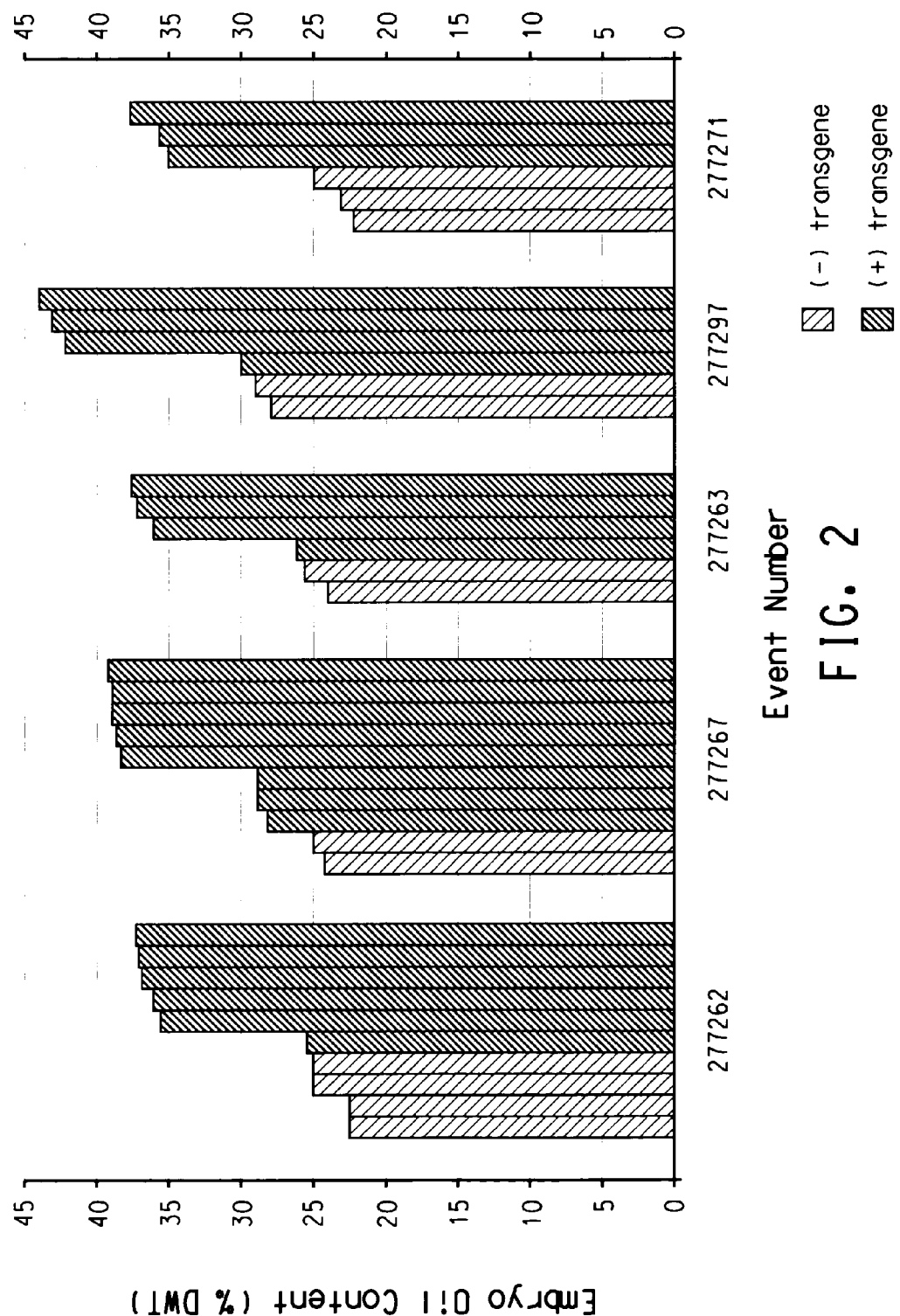

FIG. 2 shows the fatty acid composition of maize embryos transformed with additional copies of Hap3/Lec1 (solid bars, "+transgene") compared to control embryos (cross-hatched bars, "−transgene"). An oleosin promoter was used to direct the expression of a transgenic copy of Hap3/Lec 1. More than twenty events producing segregating T1 seed were analyzed by NMR for embryo oil content. Six to twelve embryos were analyzed for each of five different events. Some embryos within each event contained elevated oil content. The same embryos from these five events were analyzed by PCR to determine the presence or absence of the Lec1 construct. Embryos with high oil were always found to contain the Lec1 construct (darkly shaded bars), whereas embryos with normal levels of oil were typically found not to contain the Lec1 construct (cross-hatched bars). These data demonstrate the presence of the Lec1 gene does lead to increased oil in the embryo. It is believed that embryos containing sharply higher levels of oil were homozygous for the Lec1 construct, as these events were segregating 1:2:1. The oil concentration in the embryos containing the Lec1 construct greatly surpassed any increase previously achieved through enzymatic modification of the fatty acid biosynthetic pathway, with some embryos containing an average increase of 56% in embryo oil content.

Table 1 lists the polypeptides that are described herein, the designation of the cDNA clones that comprise the nucleic acid fragments encoding polypeptides representing all or a substantial portion of these polypeptides, and the corresponding identifier (SEQ ID NO:) as used in the attached Sequence Listing. The sequence descriptions and Sequence Listing attached hereto comply with the rules governing nucleotide and/or amino acid sequence disclosures in patent applications as set forth in 37 C.F.R. §1.821–1.825.

TABLE 1

Genes Involved in Alteration of Oil Traits in Plants

| Gene Name | Clone | Plant | SEQ ID NO |
|---|---|---|---|
| Receptor-like protein kinase | cho1c.pk003.p17:fis | maize [Zea mays] | 1, 2 |
| Receptor-like protein kinase | ceb3.pk0012.a7 | maize [Zea mays] | 3, 4 |
| MEK3 | cho1c.pk003.n23 | maize [Zea mays] | 5, 6 |
| MEK3 | p0125.czaab60rb:fis | maize [Zea mays] | 7, 8 |
| MEK3 | r1r24.pk0032.e10 | rice [Oryza sativa] | 9, 10 |
| MEK3 | r1r24.pk0032.e10:fis | rice [Oryza sativa] | 496, 497 |
| MEK3 | r10n.pk096.h23 | rice [Oryza sativa] | 11, 12 |
| MEK3 | r10n.pk096.h23:fis | rice [Oryza sativa] | 494, 495 |
| MEK3 | src3c.pk018.d10 | soybean [Glycine max] | 13, 14 |
| MEK3 | sr3c.pk011.g22 | soybean [Glycine max] | 15, 16 |
| MEK3 | sr3c.pk011.g22:fis | soybean [Glycine max] | 492, 493 |
| Hap2a transcription factor | ncs.pk0013.c4 | Catalpa [Catalpa speciosa] | 17, 18 |
| Hap2c-like transcription factor | etr1c.pk006.f9 | cattail [Typha latifolia] | 19, 20 |
| Hap2a transcription factor | vmb1na.pk015.d18:fis | grape [Vitis sp.] | 21, 22 |
| Hap2a transcription factor | vpl1c.pk008.o5:fis | grape [Vitis sp.] | 23, 24 |
| Hap2c-like transcription factor | vdb1c.pk001.m5:fis | grape [Vitis sp.] | 25, 26 |
| Hap2 transcription factor | cho1c.pk004.b19:fis | maize [Zea mays] | 27, 28 |
| Hap2 transcription factor | p0015.cdpgu90r:fis | maize [Zea mays] | 29, 30 |
| Hap2a transcription factor | cta1n.pk0070.f3:fis | maize [Zea mays] | 31, 32 |
| Hap2a-like transcription factor | cco1n.pk0014.d4:fis | maize [Zea mays] | 33, 34 |
| Hap2a-like transcription factor | cco1n.pk086.d20:fis | maize [Zea mays] | 35, 36 |
| Hap2b transcription factor | p0126.cnlau71r:fis | maize [Zea mays] | 37, 38 |
| Hap2b-like transcription factor | p0104.cabav52r | maize [Zea mays] | 39, 40 |
| Hap2c transcription factor | cho1c.pk007.l21:fis | maize [Zea mays] | 41, 42 |
| Hap2c-like transcription factor | contig of:<br>cca.pk0026.d6<br>cen3n.pk0061.e10:fis<br>cen3n.pk0135.c2<br>cho1c.pk001.n24<br>p0092.chwae40r | maize [Zea mays] | 43, 44 |
| Hap2c-like transcription factor | cpf1c.pk006.e3:fis | maize [Zea mays] | 45, 46 |
| Hap2c-like transcription factor | contig of:<br>cr1n.pk0080.g6<br>p0003.cgpge51r | maize [Zea mays] | 47, 48 |
| Hap2c-like transcription factor | p0015.cpdfm55r:fis | maize [Zea mays] | 49, 50 |
| Hap2c-like transcription factor | p0083.cldct11r:fis | maize [Zea mays] | 51, 52 |
| Hap2c-like transcription factor | p0083.cldeu68r:fis | maize [Zea mays] | 53, 54 |
| Hap2a transcription factor | pps1c.pk001.h3:fis | prickly poppy [Argemone mexicana] | 55, 56 |
| Hap2c-like transcription factor | pps1c.pk007.j21:fis | prickly poppy [Argemone mexicana] | 57, 58 |
| Hap2 transcription factor | rr1.pk0030.f7:fis | rice [Oryza sativa] | 59, 60 |
| Hap2a transcription factor | rls72.pk0023.c8:fis | rice [Oryza sativa] | 61, 62 |
| Hap2a-like transcription factor | rca1n.pk002.c15 | rice [Oryza sativa] | 63, 64 |
| Hap2a-like transcription factor | rds3c.pk001.g9 | rice [Oryza sativa] | 65, 66 |
| Hap2b transcription factor | rca1n.pk002.j3:fis | rice [Oryza sativa] | 67, 68 |
| Hap2c-like transcription factor | rca1n.pk029.n22:fis | rice [Oryza sativa] | 69, 70 |
| Hap2c-like transcription factor | rl0n.pk131.j17 | rice [Oryza sativa] | 71, 72 |
| Hap2a transcription factor | sdp3c.pk018.b9:fis | soybean [Glycine max] | 73, 74 |
| Hap2a transcription factor | sfl1.pk0102.h8 | soybean [Glycine max] | 75, 76 |

TABLE 1-continued

Genes Involved in Alteration of Oil Traits in Plants

| Gene Name | Clone | Plant | SEQ ID NO |
|---|---|---|---|
| Hap2a transcription factor | srr3c.pk001.l10:fis | soybean [*Glycine max*] | 77, 78 |
| Hap2a-like transcription factor | sdp2c.pk003.o5:fis | soybean [*Glycine max*] | 79, 80 |
| Hap2b transcription factor | sif1c.pk001.m16:fis | soybean [*Glycine max*] | 81, 82 |
| Hap2c-like transcription factor | src1c.pk003.o16:fis | soybean [*Glycine max*] | 83, 84 |
| Hap2c-like transcription factor | src3c.pk012.m6:fis | soybean [*Glycine max*] | 85, 86 |
| Hap2c-like transcription factor | hss1c.pk011.h10:fis | sunflower [*Helianthus* sp.] | 87, 88 |
| Hap2 transcription factor | wr1.pk0094.f2:fis | wheat-common [*Triticum aestivum*] | 89, 90 |
| Hap2a-like transcription factor | wre1n.pk0143.h2:fis | wheat-common [*Triticum aestivum*] | 91, 92 |
| Hap2b transcription factor | wds1f.pk002.p21:fis | wheat-common [*Triticum aestivum*] | 93, 94 |
| Hap2c transcription factor | contig of: wdi1c.pk002.b10 wr1.pk0153.c7:fis | wheat-common [*Triticum aestivum*] | 95, 96 |
| Hap2c-like transcription factor | wre1n.pk0066.e4:fis | wheat-common [*Triticum aestivum*] | 97, 98 |
| Hap5c-like transcription factor | ect1c.pk001.k17:fis | Canna [*Canna edulis*] | 99, 100 |
| Hap5a-like transcription factor | vrr1c.pk004.o20:fis | grape [*Vitis* sp.] | 101, 102 |
| Hap5a-like transcription factor | clm1f.pk001.k17:fis | maize [*Zea mays*] | 103, 104 |
| Hap5b-like transcription factor | cde1n.pk003.a5:fis | maize [*Zea mays*] | 105, 106 |
| Hap5b-like transcription factor | cen3n.pk0164.a10:fis | maize [*Zea mays*] | 107, 108 |
| Hap5b-like transcription factor | p0118.chsbc77r | maize [*Zea mays*] | 109, 110 |
| Hap5c-like transcription factor | cco1n.pk055.o18:fis | maize [*Zea mays*] | 111, 112 |
| Hap5c-like transcription factor | cho1c.pk001.l23:fis | maize [*Zea mays*] | 113, 114 |
| Hap5c-like transcription factor | cse1c.pk001.h6:fis | maize [*Zea mays*] | 115, 116 |
| Hap5a-like transcription factor | rlm3n.pk005.d20:fis | rice [*Oryza sativa*] | 117, 118 |
| Hap5b-like transcription factor | rr1.pk0003.a3:fis | rice [*Oryza sativa*] | 119, 120 |
| Hap5b-like transcription factor | rr1.pk0039.d4:fis | rice [*Oryza sativa*] | 121, 122 |
| Hap5c-like transcription factor | rca1n.pk021.b20:fis | rice [*Oryza sativa*] | 123, 124 |
| Hap5a-like transcription factor | sdp2c.pk029.k17:fis | soybean [*Glycine max*] | 125, 126 |
| Hap5a-like transcription factor | sdp2c.pk044.e5:fis | soybean [*Glycine max*] | 127, 128 |
| Hap5b-like transcription factor | sgs4c.pk004.j2 | soybean [*Glycine max*] | 129, 130 |
| Hap5b-like transcription factor | src3c.pk002.h4:fis | soybean [*Glycine max*] | 131, 132 |
| Hap5b-like transcription factor | src3c.pk009.b15:fis | soybean [*Glycine max*] | 133, 134 |
| Hap5b-like transcription factor | src3c.pk019.d4:fis | soybean [*Glycine max*] | 135, 136 |
| Hap5c-like transcription factor | sls1c.pk032.j4:fis | soybean [*Glycine max*] | 137, 138 |
| Hap5 transcription factor | wdk2c.pk009.e4:fis | wheat-common [*Triticum aestivum*] | 139, 140 |
| Hap5a-like transcription factor | contig of: wlm96.pk036.j11 wlm96.pk060.d5:fis | wheat-common [*Triticum aestivum*] | 141, 142 |
| Hap5c-like transcription factor | wle1n.pk0076.h7:fis | wheat-common [*Triticum aestivum*] | 143, 144 |
| LIP 15 transcription factor | cco1n.pk068.f18:fis | maize [*Zea mays*] | 145, 146 |
| LIP 15 transcription factor | cco1n.pk089.g17:fis | maize [*Zea mays*] | 147, 148 |
| LIP 15 transcription factor | rls6.pk0066.c9:fis | rice [*Oryza sativa*] | 149, 150 |

TABLE 1-continued

Genes Involved in Alteration of Oil Traits in Plants

| Gene Name | Clone | Plant | SEQ ID NO |
|---|---|---|---|
| LIP 15 transcription factor | sdp4c.pk009.e3:fis | soybean [*Glycine max*] | 151, 152 |
| LIP 15 transcription factor | sdp3c.pk019.n1:fis | soybean [*Glycine max*] | 153, 154 |
| LIP 15 transcription factor | wl1n.pk0114.f9:fis | wheat-common [*Triticum aestivum*] | 155, 156 |
| Ca2+ EF Hand Protein | ccase-b.pk0003.b9:fis | maize [*Zea mays*] | 157, 158 |
| Ca2+ EF Hand Protein | ceb5.pk0081.b4 | maize [*Zea mays*] | 159, 160 |
| Ca2+ EF Hand Protein | cbn10.pk0064.e6 | maize [*Zea mays*] | 161, 162 |
| Ca2+ EF Hand Protein | cml1c.pk001.e2 | maize [*Zea mays*] | 163, 164 |
| Ca2+ EF Hand Protein | cml1c.pk001.e2:fis | maize [*Zea mays*] | 498, 499 |
| Ca2+ EF Hand Protein | cpd1c.pk008.e21 | maize [*Zea mays*] | 165, 166 |
| Ca2+ EF Hand Protein | cpd1c.pk008.e21:fis | maize [*Zea mays*] | 500, 501 |
| Ca2+ EF Hand Protein | cta1n.pk0074.h11 | maize [*Zea mays*] | 167, 168 |
| Ca2+ EF Hand Protein | cta1n.pk0074.h11:fis | maize [*Zea mays*] | 502, 503 |
| Ca2+ EF Hand Protein | p0031.ccmbc81r | maize [*Zea mays*] | 169, 170 |
| Ca2+ EF Hand Protein | p0031.ccmbc81r:fis | maize [*Zea mays*] | 504, 505 |
| Ca2+ EF Hand Protein | p0134.carah41r | maize [*Zea mays*] | 171, 172 |
| Ca2+ EF Hand Protein | p0134.carah47r:fis | maize [*Zea mays*] | 506, 507 |
| Ca2+ EF Hand Protein | rca1n.pk021.i20 | rice [*Oryza sativa*] | 173, 174 |
| Ca2+ EF Hand Protein | rca1n.pk004.j14:fis | rice [*Oryza sativa*] | 175, 176 |
| Ca2+ EF Hand Protein | rca1n.pk026.m9 | rice [*Oryza sativa*] | 177, 178 |
| Ca2+ EF Hand Protein | rsl1n.pk013.g2:fis | rice [*Oryza sativa*] | 179, 180 |
| Ca2+ EF Hand Protein | sfl1.pk131.j19 | soybean [*Glycine max*] | 181, 182 |
| Ca2+ EF Hand Protein | sfl1.pk131.j19:fis | soybean [*Glycine max*] | 512, 513 |
| Ca2+ EF Hand Protein | sfl1.pk135.g3 | soybean [*Glycine max*] | 183, 184 |
| Ca2+ EF Hand Protein | sfl1.pk135.g3:fis | soybean [*Glycine max*] | 514, 515 |
| Ca2+ EF Hand Protein | sgc5c.pk001.h16 | soybean [*Glycine max*] | 185, 186 |
| Ca2+ EF Hand Protein | sls1c.pk020.h24 | soybean [*Glycine max*] | 187, 188 |
| Ca2+ EF Hand Protein | sls1c.pk020.h24:fis | soybean [*Glycine max*] | 516, 517 |
| Ca2+ EF Hand Protein | sr1.pk0041.a11 | soybean [*Glycine max*] | 189, 190 |
| Ca2+ EF Hand Protein | sr1.pk0041.a11:fis | soybean [*Glycine max*] | 518, 519 |
| Ca2+ EF Hand Protein | sr1.pk0049.c2 | soybean [*Glycine max*] | 191, 192 |
| Ca2+ EF Hand Protein | sr1.pk0049.c2:fis | soybean [*Glycine max*] | 520, 521 |
| Ca2+ EF Hand Protein | wdk5c.pk006.m13 | wheat-common [*Triticum aestivum*] | 193, 194 |
| Ca2+ EF Hand Protein | wdk5c.pk006.m13:fis | wheat-common [*Triticum aestivum*] | 522, 523 |
| Ca2+ EF Hand Protein | wdk9n.pk001.k5 | wheat-common [*Triticum aestivum*] | 195, 196 |
| Ca2+ EF Hand Protein | wdk9n.pk001.k5:fis | wheat-common [*Triticum aestivum*] | 524, 525 |
| Ca2+ EF Hand Protein | wdr1f.pk003.b21 | wheat-common [*Triticum aestivum*] | 197, 198 |
| Ca2+ EF Hand Protein | wdr1f.pk003.b21:fis | wheat-common [*Triticum aestivum*] | 526, 527 |
| ATP Citrate Lyase subunit 1 | cdo1c.pk001.c1:fis | maize [*Zea mays*] | 199, 200 |
| ATP Citrate Lyase subunit 2 | ctn1c.pk002.o4 | maize [*Zea mays*] | 201, 202 |
| ATP Citrate Lyase subunit 2 | p0032.crcav77r:fis | maize [*Zea mays*] | 203, 204 |
| ATP Citrate Lyase subunit 1 | p0037.crwbs90r:fis | maize [*Zea mays*] | 205, 206 |
| ATP Citrate Lyase subunit 1 | r10n.pk0015.a4:fis | rice [*Oryza sativa*] | 207, 208 |
| ATP Citrate Lyase subunit 1 | rlr2.pk0012.d2 | rice [*Oryza sativa*] | 209, 210 |
| ATP Citrate Lyase subunit 1 | rr1.pk097.f22:fis | rice [*Oryza sativa*] | 211, 212 |
| ATP Citrate Lyase subunit 2 | rls6.pk0033.a9:fis | rice [*Oryza sativa*] | 213, 214 |

TABLE 1-continued

Genes Involved in Alteration of Oil Traits in Plants

| Gene Name | Clone | Plant | SEQ ID NO |
|---|---|---|---|
| ATP Citrate Lyase subunit 2 | sdp2c.pk023.n6:fis | soybean [*Glycine max*] | 215, 216 |
| ATP Citrate Lyase subunit 1 | sfl1.pk0029.h10:fis | soybean [*Glycine max*] | 217, 218 |
| ATP Citrate Lyase subunit 2 | sic1c.pk003.o13:fis | soybean [*Glycine max*] | 219, 220 |
| ATP Citrate Lyase subunit 1 | sls1c.pk010.l1:fis | soybean [*Glycine max*] | 221, 222 |
| ATP Citrate Lyase subunit 2 | sls2c.pk007.c23:fis | soybean [*Glycine max*] | 223, 224 |
| ATP Citrate Lyase subunit 2 | src2c.pk009.g9:fis | soybean [*Glycine max*] | 225, 226 |
| ATP Citrate Lyase subunit 2 | wde1f.pk003.h2:fis | wheat-common [*Triticum aestivum*] | 227, 228 |
| ATP Citrate Lyase subunit 1 | wia1c.pk001.d20:fis | wheat-common [*Triticum aestivum*] | 229, 230 |
| ATP Citrate Lyase subunit 2 | wlm96.pk035.j11:fis | wheat-common [*Triticum aestivum*] | 231, 232 |
| SNF1 | cen3n.pk0044.b8:fis | maize [*Zea mays*] | 233, 234 |
| SNF1 | p0016.ctsbf56rb | maize [*Zea mays*] | 235, 236 |
| SNF1 | p0118.chsbh89r | maize [*Zea mays*] | 237, 238 |
| SNF1 | contig of: cen3n.pk0123.g6 cho1c.pk021.k16 cmm.pk007.c3 p0019.clwab.75rb p0119.cmtmj75r p0123.cammbc73r p0126.cnlds35r | maize [*Zea mays*] | 239, 240 |
| SNF1 | contig of: rda.pk0007.g3 rr1.pk0008.e12 rr1.pk0047.g12 | rice [*Oryza sativa*] | 241, 242 |
| SNF1 | rr1.pk0047.g12:fis | rice [*Oryza sativa*] | 243, 244 |
| SNF1 | sdr1f.pk001.p7 | soybean [*Glycine max*] | 247, 248 |
| SNF1 | sgs4c.pk006.g6 | soybean [*Glycine max*] | 249, 250 |
| SNF1 | sgs4c.pk006.n21 | soybean [*Glycine max*] | 251, 252 |
| SNF1 | sgs4c.pk016.e10 | soybean [*Glycine max*] | 245, 246 |
| SNF1 | srr1c.pk001.i24:fis | soybean [*Glycine max*] | 253, 254 |
| SNF1 | wdk2c.pk018.c16:fis | wheat-common [*Triticum aestivum*] | 255, 256 |
| SNF1 | wlm96.pk0007.e4:fis | wheat-common [*Triticum aestivum*] | 257, 258 |
| Lec1-embryonic type | eas1c.pk003.e16 | amaranth [*Amaranthus retroflexus*] | 259, 260 |
| Lec1-embryonic type | fds1n.pk008.m14 | balsam pear [*Momordica charantia*] | 261, 262 |
| Lec1-embryonic type | p0015.cdpgp75rb:fis | maize [*Zea mays*] | 263, 264 |
| Lec1-embryonic type | p0083.clder12r:fis | maize [*Zea mays*] | 265, 266 |
| Lec1-embryonic type | pps1c.pk002.l19 | prickly poppy [*Argemone mexicana*] | 267, 268 |
| Lec1-embryonic type | Contig of: scb1c.pk004.j10 se1.pk0042.d8:fis | soybean [*Glycine max*] | 269, 270 |
| Lec1-embryonic type | se2.11d12:fis | soybean [*Glycine max*] | 271, 272 |
| Lec1-embryonic type | ses2w.pk0015.a4:fis | soybean [*Glycine max*] | 273, 274 |
| Lec1-embryonic type | vs1n.pk013.m13:fis | vernonia [*Vernonia mespilifolia*] | 275, 276 |
| Lec1-embryonic type | wdk3c.pk023.h15:fis | wheat-common [*Triticum aestivum*] | 277, 278 |
| Lec1-related CCAAT binding protein | ect1c.pk007.p18:fis | Canna [*Canna edulis*] | 279, 280 |

TABLE 1-continued

Genes Involved in Alteration of Oil Traits in Plants

| Gene Name | Clone | Plant | SEQ ID NO |
|---|---|---|---|
| Lec1-related CCAAT binding protein | fds.pk0003.h5:fis | balsam pear [*Momordica charantia*] | 281, 282 |
| Lec1-related CCAAT binding protein | eef1c.pk004.c8:fis | eucalyptus [*Eucalyptus grandis*] | 283, 284 |
| Lec1-related CCAAT binding protein | cbn10.pk0005.e6:fis | maize [*Zea mays*] | 285, 286 |
| Lec1-related CCAAT binding protein | p0006.cbysa51r:fis | maize [*Zea mays*] | 287, 288 |
| Lec1-related CCAAT binding protein | rl0n.pk0061.c8:fis | rice [*Oryza sativa*] | 289, 290 |
| Lec1-related CCAAT binding protein | rsl1n.pk002.g10:fis | rice [*Oryza sativa*] | 291, 292 |
| Lec1-related CCAAT binding protein | ses4d.pk0037.e3:fis | soybean [*Glycine max*] | 293, 294 |
| Lec1-related CCAAT binding protein | src2c.pk003.i13:fis | soybean [*Glycine max*] | 295, 296 |
| Lec1-related CCAAT binding protein | src2c.pk011.m12:fis | soybean [*Glycine max*] | 297, 298 |
| Lec1-related CCAAT binding protein | src2c.pk025.b3:fis | soybean [*Glycine max*] | 299, 300 |
| Lec1-related CCAAT binding protein | src3c.pk028.j21:fis | soybean [*Glycine max*] | 301, 302 |
| Lec1-related CCAAT binding protein | wkm1c.pk0002.d7:fis | wheat-common [*Triticum aestivum*] | 303, 304 |
| Lec1-related CCAAT binding protein | wlk8.pk0001.e10:fis | wheat-common [*Triticum aestivum*] | 305, 306 |
| Lec1-related CCAAT binding protein | wlm96.pk037.k9:fis | wheat-common [*Triticum aestivum*] | 307, 308 |
| CKC type 6(*Aintegumenta*) | fds1n.pk015.l15 | balsam pear [*Momordica charantia*] | 309, 310 |
| CKC type 6(*Aintegumenta*) | fds1n.pk015.l15:fis contig of: | balsam pear [*Momordica charantia*] | 476, 477 |
| CKC type 2(*Aintegumenta*) | ece1c.pk003.g23 ece1c.pk005.j13 | castor bean [*Ricinus communis*] | 311, 312 |
| CKC type 2(*Aintegumenta*) | ece1c.pk003.g23:fis | castor bean [*Ricinus communis*] | 478, 479 |
| CKC type 8(*Aintegumenta*) | ids.pk0022.b6 contig of: | garden balsam [*Impatiens balsamia*] | 313, 314 |
| CKC type 1(*Aintegumenta*) | cpd1c.pk011.i5 p0086.cbsaa24r:fis | maize [*Zea mays*] | 315, 316 |
| CKC type 1(*Aintegumenta*) | cpd1c.pk011.i5:fis | maize [*Zea mays*] | 317, 318 |
| CKC type 2(*Aintegumenta*) | cde1c.pk003.o22:fis | maize [*Zea mays*] | 319, 320 |
| CKC type 2(*Aintegumenta*) | cho1c.pk003.f17:fis contig of: | maize [*Zea mays*] | 321, 322 |
| CKC type 5(*Aintegumenta*) | cds1f.pk003.b12 clm1f.pk002.o13:fis | maize [*Zea mays*] | 323, 324 |
| CKC type 3(*Aintegumenta*) | p0015.cdpfn03r contig of: | maize [*Zea mays*] | 325, 326 |
| CKC type 3(*Aintegumenta*) | cc71se-a.pk0002.e11 p0027.cgsag51r:fis | maize [*Zea mays*] | 327, 328 |
| CKC type 6(*Aintegumenta*) | p0031.ccmau15r:fis | maize [*Zea mays*] | 329, 330 |
| CKC type 8(*Aintegumenta*) | cc71se-b.pk0018.e4:fis | maize [*Zea mays*] | 331, 332 |
| CKC type 7(*Aintegumenta*) | cpj1c.pk005.m20:fis | maize [*Zea mays*] | 333, 334 |
| CKC type 7(*Aintegumenta*) | ncs.pk0013.a9:fis | *Catalpa speciosa* | 484, 485 |
| CKC type 8(*Aintegumenta*) | egh1c.pk005.k20:fis | maize [*Zea mays*] | 486, 487 |
| CKC type 8(*Aintegumenta*) | cen7f.pk002.m15 | maize [*Zea mays*] | 335, 336 |
| CKC type 8(*Aintegumenta*) | cde1c.pk003.n23:fis | maize [*Zea mays*] | 488, 489 |

TABLE 1-continued

Genes Involved in Alteration of Oil Traits in Plants

| Gene Name | Clone | Plant | SEQ ID NO |
|---|---|---|---|
| CKC type 8 (Aintegumenta) | rsl1n.pk006.n24:fis contig of: | rice [Oryza sativa] | 337, 338 |
| CKC type 8 (Aintegumenta) | rca1n.pk019.p10 rsl1n.pk002.j2:fis | rice [Oryza sativa] | 339, 340 |
| CKC type 1 (Aintegumenta) | rdi2c.pk009.a15 | rice [Oryza sativa] | 341, 342 |
| CKC type 2 (Aintegumenta) | sds1f.pk001.f7:fis | soybean [Glycine max] | 343, 344 |
| CKC type 2 (Aintegumenta) | se3.pk0034.a3 | soybean [Glycine max] | 345, 346 |
| CKC type 6 (Aintegumenta) | ses2w.pk0035.a9:fis | soybean [Glycine max] | 347, 348 |
| CKC type 4 (Aintegumenta) | ses4d.pk0043.d10:fis | soybean [Glycine max] | 349, 350 |
| CKC type 5 (Aintegumenta) | scb1c.pk004.n19:fis | soybean [Glycine max] | 351, 352 |
| CKC type 5 (Aintegumenta) | ses4d.pk0006.a12:fis | soybean [Glycine max] | 353, 354 |
| CKC type 5 (Aintegumenta) | sgs1c.pk004.f19:fis | soybean [Glycine max] | 355, 356 |
| CKC type 8 (Aintegumenta) | sic1c.pk003.o18:fis | soybean [Glycine max] | 357, 358 |
| CKC type 8 (Aintegumenta) | sde4c.pk0001.a2 | soybean [Glycine max] | 359, 360 |
| CKC type 8 (Aintegumenta) | sde4c.pk0001.a2:fis | soybean [Glycine max] | 490, 491 |
| CKC type 3 (Aintegumenta) | ses2w.pk0012.d10:fis contig of: | soybean [Glycine max] | 361, 362 |
| CKC type 1 (Aintegumenta) | wde1f.pk001h1 wr1.pk148.f7:fis | wheat-common [Triticum aestivum] | 363, 364 |

The Sequence Listing contains the one letter code for nucleotide sequence characters and the three letter codes for amino acids as defined in conformity with the IUPAC-IUBMB standards described in *Nucleic Acids Res.* 13:3021–3030 (1985) and in the *Biochemical J.* 219 (No. 2):345–373 (1984) which are herein incorporated by reference. The symbols and format used for nucleotide and amino acid sequence data comply with the rules set forth in 37 C.F.R. §1.822.

DETAILED DESCRIPTION OF THE INVENTION

All patents, patent applications and publications which are referred to herein are incorporated by reference in their entirety.

As used herein, an "isolated nucleic acid fragment" is a polymer of RNA or DNA that is single- or double-stranded, optionally containing synthetic, non-natural or altered nucleotide bases. An isolated nucleic acid fragment in the form of a polymer of DNA may be comprised of one or more segments of cDNA, genomic DNA or synthetic DNA. Nucleotides (usually found in their 5'-monophosphate form) are referred to by their single letter designation as follows: "A" for adenylate or deoxyadenylate (for RNA or DNA, respectively), "C" for cytidylate or deoxycytidylate, "G" for guanylate or deoxyguanylate, "U" for uridylate, "T" for deoxythymidylate, "R" for purines (A or G), "Y" for pyrimidines (C or T), "K" for g or T, "H" for A or C or T, "I" for inosine, and "N" for any nucleotide.

The terms "subfragment that is functionally equivalent" and "functionally equivalent subfragment" are used interchangeably herein. These terms refer to a portion or subsequence of an isolated nucleic acid fragment in which the ability to alter gene expression or produce a certain phenotype is retained whether or not the fragment or subfragment encodes an active enzyme. For example, the fragment or subfragment can be used in the design of chimeric genes to produce the desired phenotype in a transformed plant. Chimeric genes can be designed for use in co-suppression or antisense by linking a nucleic acid fragment or subfragment thereof, whether or not it encodes an active enzyme, in the appropriate orientation relative to a plant promoter sequence.

The terms "homology", "homologous", "substantially similar" and "corresponding substantially" are used interchangeably herein. They refer to nucleic acid fragments wherein changes in one or more nucleotide bases does not affect the ability of the nucleic acid fragment to mediate gene expression or produce a certain phenotype. These terms also refer to modifications of the nucleic acid fragments of the instant invention such as deletion or insertion of one or more nucleotides that do not substantially alter the functional properties of the resulting nucleic acid fragment relative to the initial, unmodified fragment. It is therefore understood, as those skilled in the art will appreciate, that the invention encompasses more than the specific exemplary sequences.

Moreover, the skilled artisan recognizes that substantially similar nucleic acid sequences encompassed by this invention are also defined by their ability to hybridize, under moderately stringent conditions (for example, 0.5×SSC, 0.1% SDS, 60° C.) with the sequences exemplified herein, or to any portion of the nucleotide sequences reported herein and which are functionally equivalent to the promoter of the invention. Stringency conditions can be adjusted to screen for moderately similar fragments, such as homologous sequences from distantly related organisms, to highly similar fragments, such as genes that duplicate functional enzymes from closely related organisms. Post-hybridization washes determine stringency conditions. One set of preferred conditions involves a series of washes starting with 6×SSC, 0.5% SDS at room temperature for 15 min, then repeated with 2×SSC, 0.5% SDS at 45° C. for 30 min, and then repeated twice with 0.2×SSC, 0.5% SDS at 50° C. for 30 min. A more preferred set of stringent conditions involves the use of higher temperatures in which the washes are identical to those above except for the temperature of the final two 30 min washes in 0.2×SSC, 0.5% SDS was increased to 60° C. Another preferred set of highly stringent conditions involves the use of two final washes in 0.1×SSC, 0.1% SDS at 65° C.

With respect to the degree of substantial similarity between the target (endogenous) mRNA and the RNA region in the construct having homology to the target mRNA, such sequences should be at least 25 nucleotides in length, preferably at least 50 nucleotides in length, more preferably at least 100 nucleotides in length, again more preferably at least 200 nucleotides in length, and most preferably at least 300 nucleotides in length; and should be at least 80% identical, preferably at least 85% identical, more preferably at least 90% identical, and most preferably at least 95% identical.

Sequence alignments and percent similarity calculations may be determined using a variety of comparison methods designed to detect homologous sequences including, but not limited to, the Megalign program of the LASARGENE bioinformatics computing suite (DNASTAR Inc., Madison, Wis.). Multiple alignment of the sequences are performed using the Clustal method of alignment (Higgins and Sharp (1989) *CABIOS*. 5:151–153) with the default parameters (GAP PENALTY=10, GAP LENGTH PENALTY=10). Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4.

A "substantial portion" of an amino acid or nucleotide sequence comprises an amino acid or a nucleotide sequence that is sufficient to afford putative identification of the protein or gene that the amino acid or nucleotide sequence comprises. Amino acid and nucleotide sequences can be evaluated either manually by one skilled in the art, or by using computer-based sequence comparison and identification tools that employ algorithms such as BLAST (Basic Local Alignment Search Tool; Altschul et al (1993) *J. Mol. Biol.* 215:403–410; see also www.ncbi.nlm.nih.gov/BLAST/). In general, a sequence of ten or more contiguous amino acids or thirty or more contiguous nucleotides is necessary in order to putatively identify a polypeptide or nucleic acid sequence as homologous to a known protein or gene. Moreover, with respect to nucleotide sequences, gene-specific oligonucleotide probes comprising 30 or more contiguous nucleotides may be used in sequence-dependent methods of gene identification (e.g., Southern hybridization) and isolation (e.g., in situ hybridization of bacterial colonies or bacteriophage plaques). In addition, short oligonucleotides of 12 or more nucleotides may be used as amplification primers in PCR in order to obtain a particular nucleic acid fragment comprising the primers. Accordingly, a "substantial portion" of a nucleotide sequence comprises a nucleotide sequence that will afford specific identification and/or isolation of a nucleic acid fragment comprising the sequence. The instant specification teaches amino acid and nucleotide sequences encoding polypeptides that comprise one or more particular plant proteins. The skilled artisan, having the benefit of the sequences as reported herein, may now use all or a substantial portion of the disclosed sequences for purposes known to those skilled in this art. Accordingly, the instant invention comprises the complete sequences as reported in the accompanying Sequence Listing, as well as substantial portions of those sequences as defined above.

"Codon degeneracy" refers to divergence in the genetic code permitting variation of the nucleotide sequence without effecting the amino acid sequence of an encoded polypeptide. Accordingly, the instant invention relates to any nucleic acid fragment comprising a nucleotide sequence that encodes all or a substantial portion of the amino acid sequences set forth herein. The skilled artisan is well aware of the "codon-bias" exhibited by a specific host cell in usage of nucleotide codons to specify a given amino acid. Therefore, when synthesizing a nucleic acid fragment for improved expression in a host cell, it is desirable to design the nucleic acid fragment such that its frequency of codon usage approaches the frequency of preferred codon usage of the host cell.

"Synthetic nucleic acid fragments" can be assembled from oligonucleotide building blocks that are chemically synthesized using procedures known to those skilled in the art. These building blocks are ligated and annealed to form larger nucleic acid fragments which may then be enzymatically assembled to construct the entire desired nucleic acid fragment. "Chemically synthesized", as related to a nucleic acid fragment, means that the component nucleotides were assembled in vitro. Manual chemical synthesis of nucleic acid fragments may be accomplished using well established procedures, or automated chemical synthesis can be performed using one of a number of commercially available machines. Accordingly, the nucleic acid fragments can be tailored for optimal gene expression based on optimization of the nucleotide sequence to reflect the codon bias of the host cell. The skilled artisan appreciates the likelihood of successful gene expression if codon usage is biased towards those codons favored by the host. Determination of preferred codons can be based on a survey of genes derived from the host cell where sequence information is available.

"Gene" refers to a nucleic acid fragment that expresses a specific protein, including regulatory sequences preceding (5' non-coding sequences) and following (3' non-coding sequences) the coding sequence. "Native gene" refers to a gene as found in nature with its own regulatory sequences. The term "chimeric gene" and "chimeric construct" are used interchangeably herein. A chimeric construct comprises an artificial combination of nucleic acid fragments, e.g., regulatory and coding sequences that are not found together in nature. For example, a chimeric construct may comprise regulatory sequences and coding sequences that are derived from different sources, or regulatory sequences and coding sequences derived from the same source, but arranged in a manner different than that found in nature. A "foreign" gene refers to a gene not normally found in the host organism, but that is introduced into the host organism by gene transfer. Foreign genes can comprise native genes inserted into a non-native organism, or chimeric genes. A "transgene" is a gene that has been introduced into the genome by a transformation procedure.

"Coding sequence" refers to a DNA sequence that codes for a specific amino acid sequence. "Regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include, but are not limited to, promoters, translation leader sequences, introns, and polyadenylation recognition sequences.

"Promoter" refers to a DNA sequence capable of controlling the expression of a coding sequence or functional RNA. The promoter sequence consists of proximal and more distal upstream elements, the latter elements often referred to as enhancers. Accordingly, an "enhancer" is a DNA sequence which can stimulate promoter activity and may be an innate element of the promoter or a heterologous element inserted to enhance the levelor tissue-specificity of a promoter. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental conditions. Promoters which cause a gene to be expressed in most cell types at most times are commonly referred to as "constitutive promoters". New promoters of various types useful in plant cells are constantly being discovered; numerous examples may be found in the compilation by Okamuro and Goldberg, (1989) *Biochemistry of Plants* 15:1–82. It is further recognized that since in most cases the exact boundaries of regulatory sequences have not been completely defined, DNA fragments of some variation may have identical promoter activity.

An "intron" is an intervening sequence in a gene that does not encode a portion of the protein sequence. Thus, such sequences are transcribed into RNA but are then excised and are not translated. The term is also used for the excised RNA sequences. An "exon" is a portion of the sequence of a gene that is transcribed and is found in the mature messenger RNA derived from the gene, but is not necessarily a part of the sequence that encodes the final gene product.

The "translation leader sequence" refers to a DNA sequence located between the promoter sequence of a gene and the coding sequence. The translation leader sequence is present in the fully processed mRNA upstream of the translation start sequence. The translation leader sequence may affect processing of the primary transcript to mRNA, mRNA stability or translation efficiency. Examples of translation leader sequences have been described (Turner, R. and Foster, G. D. (1995) *Molecular Biotechnology* 3:225).

The "3' non-coding sequences" refer to DNA sequences located downstream of a coding sequence and include polyadenylation recognition sequences and other sequences encoding regulatory signals capable of affecting mRNA processing or gene expression. The polyadenylation signal is usually characterized by affecting the addition of polyadenylic acid tracts to the 3' end of the mRNA precursor. The use of different 3' non-coding sequences is exemplified by Ingelbrecht et al, (1989) *Plant Cell* 1:671–680.

"RNA transcript" refers to the product resulting from RNA polymerase-catalyzed transcription of a DNA sequence. When the RNA transcript is a perfect complementary copy of the DNA sequence, it is referred to as the primary transcript or it may be a RNA sequence derived from post-transcriptional processing of the primary transcript and is referred to as the mature RNA. "Messenger RNA (mRNA)" refers to the RNA that is without introns and that can be translated into protein by the cell. "cDNA" refers to a DNA that is complementary to and synthesized from a mRNA template using the enzyme reverse transcriptase. The cDNA can be single-stranded or converted into the double-stranded form using the Klenow fragment of DNA polymerase 1. "Sense" RNA refers to RNA transcript that includes the mRNA and can be translated into protein within a cell or in vitro. "Antisense RNA" refers to an RNA transcript that is complementary to all or part of a target primary transcript or mRNA and that blocks the expression of a target gene (U.S. Pat. No. 5,107,065). The complementarity of an antisense RNA may be with any part of the specific gene transcript, i.e., at the 5' non-coding sequence, 3' non-coding sequence, introns, or the coding sequence. "Functional RNA" refers to antisense RNA, ribozyme RNA, or other RNA that may not be translated but yet has an effect on cellular processes. The terms "complement" and "reverse complement" are used interchangeably herein with respect to mRNA transcripts, and are meant to define the antisense RNA of the message.

The term "endogenous RNA" refers to any RNA which is encoded by any nucleic acid sequence present in the genome of the host prior to transformation with the recombinant construct of the present invention, whether naturally-occurring or non-naturally occurring, i.e., introduced by recombinant means, mutagenesis, etc.

The term "non-naturally occurring" means artificial, not consistent with what is normally found in nature.

The term "operably linked" refers to the association of nucleic acid sequences on a single nucleic acid fragment so that the function of one is regulated by the other. For example, a promoter is operably linked with a coding sequence when it is capable of regulating the expression of that coding sequence (i.e., that the coding sequence is under the transcriptional control of the promoter). Coding sequences can be operably linked to regulatory sequences in a sense or antisense orientation. In another example, the complementary RNA regions of the invention can be operably linked, either directly or indirectly, 5' to the target mRNA, or 3' to the target mRNA, or within the target mRNA, or a first complementary region is 5' and its complement is 3' to the target mRNA.

The term "expression", as used herein, refers to the production of a functional end-product. Expression of a gene involves transcription of the gene and translation of the mRNA into a precursor or mature protein. "Antisense inhibition" refers to the production of antisense RNA transcripts capable of suppressing the expression of the target protein. "Co-suppression" refers to the production of sense RNA transcripts capable of suppressing the expression of identical or substantially similar foreign or endogenous genes (U.S. Pat. No. 5,231,020).

"Mature" protein refers to a post-translationally processed polypeptide; i.e., one from which any pre- or propeptides present in the primary translation product have been removed. "Precursor" protein refers to the primary product of translation of mRNA; i.e., with pre- and propeptides still present. Pre- and propeptides may be but are not limited to intracellular localization signals.

"Stable transformation" refers to the transfer of a nucleic acid fragment into a genome of a host organism, including both nuclear and organellar genomes, resulting in genetically stable inheritance. In contrast, "transient transformation" refers to the transfer of a nucleic acid fragment into the nucleus, or DNA-containing organelle, of a host organism resulting in gene expression without integration or stable inheritance. Host organisms containing the transformed nucleic acid fragments are referred to as "transgenic" organisms. The preferred method of cell transformation of rice, corn and other monocots is the use of particle-accelerated or "gene gun" transformation technology (Klein et al, (1987) *Nature* (*London*) 327:70–73; U.S. Pat. No. 4,945,050), or an Agrobacterium-mediated method using an appropriate Ti plasmid containing the transgene (Ishida Y. et al, 1996, *Nature Biotech.* 14:745–750). The term "transformation" as used herein refers to both stable transformation and transient transformation.

Standard recombinant DNA and molecular cloning techniques used herein are well known in the art and are described more fully in Sambrook, J., Fritsch, E. F. and Maniatis, T. *Molecular Cloning: A Laboratory Manual;* Cold Spring Harbor Laboratory Press: Cold Spring Harbor, 1989 (hereinafter "Sambrook").

The term "recombinant" means, for example, that a nucleic acid sequence is made by an artificial combination of two otherwise separated segments of sequence, e.g., by chemical synthesis or by the manipulation of isolated nucleic acids by genetic engineering techniques. A "recombinant DNA construct" comprises an isolated polynucleotide operably linked to at least one regulatory sequence. The term also embraces an isolated polynucleotide comprising a region encoding all or part of a functional RNA and at least one of the naturally occurring regulatory sequences directing expression in the source (e.g., organism) from which the polynucleotide was isolated, such as, but not limited to, an isolated polynucleotide comprising a nucleotide sequence encoding a herbicide resistant target gene and the corresponding promoter and 3' end sequences directing expression in the source from which sequences were isolated.

A "transgene" is a recombinant DNA construct that has been introduced into the genome by a transformation procedure.

As used herein, "contig" refers to a nucleotide sequence that is assembled from two or more constituent nucleotide sequences that share common or overlapping regions of sequence homology. For example, the nucleotide sequences of two or more nucleic acid fragments can be compared and aligned in order to identify common or overlapping sequences. Where common or overlapping sequences exist between two or more nucleic acid fragments, the sequences (and thus their corresponding nucleic acid fragments) can be assembled into a single contiguous nucleotide sequence.

"PCR" or "Polymerase Chain Reaction" is a technique for the synthesis of large quantities of specific DNA segments, consists of a series of repetitive cycles (Perkin Elmer Cetus Instruments, Norwalk, Conn.). Typically, the double stranded DNA is heat denatured, the two primers complementary to the 3' boundaries of the target segment are annealed at low temperature and then extended at an intermediate temperature. One set of these three consecutive steps is referred to as a cycle.

The terms "recombinant construct", "expression construct", "recombinant expression construct", "chimeric construct" and "chimeric gene" are used interchangeably herein. Such construct may be itself or may be used in conjunction with a vector. If a vector is used then the choice of vector is dependent upon the method that will be used to transform host plants as is well known to those skilled in the art. For example, a plasmid vector can be used. The skilled artisan is well aware of the genetic elements that must be present on the vector in order to successfully transform, select and propagate host cells comprising any of the isolated nucleic acid fragments of the invention. The skilled artisan will also recognize that different independent transformation events will result in different levels and patterns of expression (Jones et al, (1985) *EMBO J.* 4:2411–2418; De Almeida et al, (1989) *Mol. Gen. Genetics* 218:78–86), and thus that multiple events must be screened in order to obtain lines displaying the desired expression level and pattern. Such screening may be accomplished by Southern analysis of DNA, Northern analysis of mRNA expression, Western analysis of protein expression, or phenotypic analysis.

Co-suppression constructs in plants previously have been designed by focusing on overexpression of a nucleic acid sequence having homology to an endogenous mRNA, in the sense orientation, which results in the reduction of all RNA having homology to the overexpressed sequence (see Vaucheret et al (1998) *Plant J* 16:651–659; and Gura (2000) *Nature* 404:804–808). The overall efficiency of this phenomenon is low, and the extent of the RNA reduction is widely variable. Recent work has described the use of "hairpin" structures that incorporate all, or part, of an mRNA encoding sequence in a complementary orientation that results in a potential "stem-loop" structure for the expressed RNA (PCT Publication WO 99/53050 published on Oct. 21, 1999). This increases the frequency of co-suppression in the recovered transgenic plants. Another variation describes the use of plant viral sequences to direct the suppression, or "silencing", of proximal mRNA encoding sequences (PCT Publication WO 98/36083 published on Aug. 20, 1998). Both of these co-suppressing phenomena have not been elucidated mechanistically, although recent genetic evidence has begun to unravel this complex situation (Elmayan et al (1998) *Plant Cell* 10:1747–1757).

Alternatively, a chimeric gene designed to express antisense RNA for all or part of the instant nucleic acid fragment can be constructed by linking the gene or gene fragment in reverse orientation to plant promoter sequences. Either the co-suppression or antisense chimeric genes could be introduced into plants via transformation wherein expression of the corresponding endogenous genes are reduced or eliminated.

Molecular genetic solutions to the generation of plants with altered gene expression have a decided advantage over more traditional plant breeding approaches. Changes in plant phenotypes can be produced by specifically inhibiting expression of one or more genes by antisense inhibition or cosuppression (U.S. Pat. Nos. 5,190,931, 5,107,065 and 5,283,323). An antisense or cosuppression construct would act as a dominant negative regulator of gene activity. While conventional mutations can yield negative regulation of gene activity these effects are most likely recessive. The dominant negative regulation available with a transgenic approach may be advantageous from a breeding perspective. In addition, the ability to restrict the expression of a specific phenotype to the reproductive tissues of the plant by the use of tissue specific promoters may confer agronomic advantages relative to conventional mutations which may have an effect in all tissues in which a mutant gene is ordinarily expressed.

The person skilled in the art will know that special considerations are associated with the use of antisense or cosuppression technologies in order to reduce expression of particular genes. For example, the proper level of expression of sense or antisense genes may require the use of different chimeric constructs utilizing different regulatory elements known to the skilled artisan. Once transgenic plants are obtained by one of the methods described above, it will be necessary to screen individual transgenics for those that most effectively display the desired phenotype. Accordingly, the skilled artisan will develop methods for screening large numbers of transformants. The nature of these screens will generally be chosen on practical grounds. For example, one can screen by looking for changes in gene expression by using antibodies specific for the protein encoded by the gene being suppressed, or one could establish assays that specifically measure enzyme activity. A preferred method will be one which allows large numbers of samples to be processed rapidly, since it will be expected that a large number of transformants will be negative for the desired phenotype.

Loss of function mutant phenotypes may be identified for the instant cDNA clones either by targeted gene disruption protocols or by identifying specific mutants for these genes contained in a maize population carrying mutations in all possible genes (Ballinger and Benzer (1989) *Proc. Natl. Acad. Sci USA* 86:9402–9406; Koes et al (1995) *Proc. Natl. Acad. Sci USA* 92:8149–8153; Bensen et al (1995) *Plant Cell* 7:75–84). The latter approach may be accomplished in two ways. First, short segments of the instant nucleic acid fragments may be used in polymerase chain reaction protocols in conjunction with a mutation tag sequence primer on DNAs prepared from a population of plants in which Mutator transposons or some other mutation-causing DNA element has been introduced (see Bensen, supra). The amplification of a specific DNA fragment with these primers indicates the insertion of the mutation tag element in or near the plant gene encoding the instant polypeptides. Alternatively, the instant nucleic acid fragment may be used as a hybridization probe against PCR amplification products generated from the mutation population using the mutation tag sequence primer in conjunction with an arbitrary genomic site primer, such as that for a restriction enzyme site-anchored synthetic adaptor. With either method, a plant containing a mutation in the endogenous gene encoding the instant polypeptides can be identified and obtained. This mutant plant can then be used to determine or confirm the natural function of the instant polypeptides disclosed herein.

The terms Hap3, Lecd, and Hap3/Lec1 are used interchangeably herein and refer to a class of transcription factors. The Hap3/Lec1 class is part of a broader family that includes other transcription factors such as Hap5, Hap2, and Lec1-CCAAT. The terms Hap3-like, Lec1 -like, Hap3/Lec1-like, Hap5-like, Hap2-like, Lec1-CCAAT-like, etc. refer to any transcription factors that share sequence identity as disclosed herein and/or functionality with the nucleotide sequences and the corresponding amino acid sequences encoded by such nucleotide sequences disclosed in the present invention.

Similarly, LIP15, SNF1, and CKC Ainteguementa are also transcription factors that are believed to alter oil phenotypes in plants. it is believed that MAP kinase 3, receptor-like protein kinase, calcium EF-hand protein and ATP citrate lyase are members of protein families that also influence oil accumulation in plants. The suffix "-like" added to any named nucleic acid or amino acid sequence of the aforementioned families refers to additional members of the respective families that share sequence identity as disclosed herein and/or functionality with the nucleotide sequences and the corresponding amino acid sequences encoded by such nucleotide sequences disclosed in the present invention.

Surprisingly and unexpectedly, it has been found that there are a variety of regulatory/structural nucleic acid fragments, which heretofore have not been associated with altering oil phenotype in plants, that appear to be useful in altering oil phenotype in plants. In addition to the CCAAT-binding transcription factors, other proteins which heretofore have not been associated with altering oil phenotype in plants, have been identified. The nucleic acids identified encode a diverse class of regulatory and structural polypeptides whose expression correlates with altered oil phenotypes in plants. Altering the expression of these polypeptides would be expected to have an effect in altering oil accumulation in plants.

Other protein classes identified herein include:

a receptor-like protein kinase;

a MAP kinase 3;

a Hap2 transcription factor;

a Hap5 transcription factor;

a LIP15 transcription factor;

a calcium-binding EF-hand protein;

an ATP citrate lyase that catalyzes the formation of cytosolic acetyl CoA (Rangasamy and Ratledge (1999) Mol Cell Biol 19:450–460; PCT Publication No. WO 00/00619 published on Jan. 6, 2000, which discloses an *Arabidopsis thaliana* ATP citrate lyase);

a SNF1 transcription factors involved in glucose metabolism;

a Hap3/Lec1 or Lec1-CCAAT binding transcription factor; or a seed developmental transcription factor CKC related to an Ainteguementa transcription factor.

They can be characterized as an isolated nucleotide fragment comprising a nucleic acid sequence selected from the group consisting of:

(a) a nucleic acid sequence encoding a first polypeptide having receptor-like protein kinase activity, the first polypeptide having at least 85% identity based on the Clustal method of alignment when compared to a second polypeptide selected from the group consisting of SEQ ID NOs: 2 or 4; or (b) a nucleic acid sequence encoding a third polypeptide having MAP kinase-kinase-kinase activity, the third polypeptide having at least 70% identity based on the Clustal method of alignment when compared to a fourth polypeptide selected from the group consisting of SEQ ID NOs: 6, 8, 10, 12, 14, 16, 493, 495, or 497; or (c) a nucleic acid sequence encoding a fifth polypeptide having Hap2-like transcription factor activity, the fifth polypeptide having at least 70% identity based on the Clustal method of alignment when compared to a sixth polypeptide selected from the group consisting of SEQ ID NOs: 18, 20, 22, 26, 28, 30, 32, 34, 36, 38, 40, 42, 44, 46, 48, 50, 52, 54, 56, 58, 62, 64, 66, 68, 70, 72, 74, 76, 78, 80, 82, 84, 86, 88, 90, 92, 94, 96, 98, 461, 463, 465, 467, or 469; or (d) a nucleic acid sequence encoding a seventh polypeptide having Hap5-like transcription factor activity, the seventh polypeptide having at least 80% identity based on the Clustal method of alignment when compared to an eighth polypeptide selected from the group consisting of SEQ ID NOs: 100, 102, 104, 106, 108, 110, 112, 114, 116, 118, 120, 122, 124, 126, 128, 130, 132, 134, 136, 138, 140, 142, or 144, or 474; or (e) a nucleic acid sequence encoding a ninth polypeptide having LIP15-like transcription factor activity, the ninth polypeptide having at least 85% identity based on the Clustal method of alignment when compared to a tenth polypeptide selected from the group consisting of SEQ ID NOs: 148, 152, or 154; or (f) a nucleic acid sequence encoding an eleventh polypeptide caleosin-like activity, the eleventh polypeptide having at least 70% identity based on the Clustal method of alignment when compared to a twelfth polypeptide selected from the group consisting of SEQ ID NOs: 158, 160, 162, 164, 166, 168, 170, 172, 174, 176, 178, 180, 182, 184, 186, 188, 190, 192, 194, 196, 198, 499, 501, 503, 505, 507, 509, 511, 513, 515, 517, 519, 521, 523, 525, or527; or (g) a nucleic acid sequence encoding a thirteenth polypeptide having ATP citrate lyase activity, the thirteenth polypeptide having at least 94% identity based on the Clustal method of alignment when compared to a fourteenth polypeptide selected from the group consisting of SEQ ID NOs: 200, 202, 204, 206, 208, 210, 212, 214, 216, 218, 220, 222, 224, 226, 228, 230, or 232; or (h) a nucleic acid sequence encoding a fifteenth polypeptide having SNF1-like activity, the fifteenth polypeptide having at least 90% identity based on the Clustal method of alignment when compared to a sixteenth polypeptide selected from the group consisting of SEQ ID NOs: 244, 256, or 258; or (i) a nucleic acid sequence encoding a seventeenth polypeptide having Hap3/Lec1-like activity, the seventeenth polypeptide having at least 70% identity based on the Clustal method of alignment when compared to a eighteenth polypeptide selected from the group consisting of SEQ ID NOs: 260, 262, 264, or 266; or (j) a nucleic acid sequence encoding a nineteenth polypeptide having Aintegumenta-like transcription factor activity, the nineteenth polypeptide having at least 88% identity based on the Clustal method of alignment when compared to an twentieth polypeptide selected from the group consisting of SEQ ID NOs: 310, 312, 316, 318, 320, 328, 330, 332, 338, 342, 344, 348, 352, 354, 358, 362, 477, 479, 481, 483, 485, 487, 489, or 491.

It is understood by one skilled in the art that other percent identity ranges may be useful in the above mentioned characterization. Useful percent identities would include, but not be limited to, 45%, 55%, 60%, 65%, 70%, 75%, 80%, 85%, 90%, 95% and all integer percentages from 45 to 100%.

The complement of the nucleotide fragments of this inventions are encompassed within the scope of this invention.

Those skilled in the art with also appreciate that the nucleotide fragment of this invention and/or the complement thereof can be used in whole or in part in antisense inhibition or co-suppression of a transformed plant.

In a more preferred embodiment, the first polypeptide mentioned above is as follows with respect to each part, the first polypeptide in part (a) is a receptor-like protein kinase (RLK);
part (b) is a MAP kinase 3;
part (c) is a Hap2 transcription factor;
part (d) is a Hap5 transcription factor;
part (e) is a LIP15 transcription factor;
part (f) is a calcium-binding EF-hand protein;
part (g) is an ATP citrate lyase;
part (h) is a SNF1 transcription factor
part (i) is a Hap3/Lec1 or Lec1-CCAAT binding transcription factor
part (j) is a seed development transcription factor similar to Aintegumenta.

Plant receptor-like protein kinases (RLKs) constitute a large family of RLKs that are remarkable for their diversity in their structural and functional properties and therefore open a broad area of investigation into cellular signalling in plants with far-reaching implications for the mechanisms by which plant cells perceive and respond to extracellular signals. The plant counterparts of membrane-related protein kinase activity (RLKs) show structural similarity to animal polypeptide growth factor receptors that contain an extracellular ligand-binding domain, a single membrane-spanning region, and a conserved cytoplasmic domain with protein kinase activity. Most of the equivalent animal protein kinase receptors are Tyr kinases, whereas in plants, most of the identified kinase receptors, belong to the family of Ser/Thr protein kinases. Based on the structural similarity of their extracellular region RLKs are classified into three main categories: the S domain class, the LRR class, and the group that carries epidermal growth factor-like repeats (Braun and Walker (1996) *Trends Biochem.* 21: 70–73). A novel class of receptor kinases containing a taumatin-like domain is related to plant defense proteins (Wang et al (1996) *Proc Natl Acad Sci USA* 93: 2598–2602). The diversity of structure and array of gene expression patterns different members of the RLK family suggest that they respond to diverse extracellular signals and display different physiological functions. A variety of signalling molecules responsible for the transmission of information downstream from animal receptor tyrosine kinases, have been revealed in animals. In higher plants, evidence has been obtained for the existence of a number of soluble, cytoplasmic serine protein kinases including raf-like protein kinases, elements of the MAPkinase pathway, protein phosphatases and G-proteins. It is therefore likely that plant RLKs are components of signalling pathways similar to those described in animals and are involved in regulating a wide range of cellular processes including carbohydrate partitioning (Walker (1994) *Plant Mol Biol* 26:1599–1609).

ATP-dependent citrate lyase (ACL) enzymes have been found in bacteria (Wahlund and Tabita (1997) *J Bacteriol* 179: 4859–4867), all animal tissues (Srere (1959) *J Biol Chem* 234: 2544–2547), some oleaginous yeasts and molds (Guerritore and Honozet (1970) *Experientia* 26: 28–30. Lowry et al (1951) *J Biol Chem* 193: 265–275), plants (Fritsch and Beevers (1979) *Plant Physiol* 63:687–691), and green algae (Chen and Gibbs (1992) *Plant Physiol* 98: 535–539). The function of this enzyme in eukaryotes is to provide cytosolic acetyl-CoA for biosynthesis of fats, cholesterols, and gangliosides, whereas in bacteria ACL has been found only in organisms, which employ the reductive TCA cycle to assimilate $CO_2$ into cell material. In eukaryotes ACL is a cytosolic enzyme that catalyses the formation of acetyl-CoA and oxaloacetate from coenzyme A and citrate, with concomitant hydrolysis of ATP. Animal ACL polypeptides have a molecular mass of 110–120 kDa and are encoded by a single gene. In plants and filamentous fungi, ACL consists of two different subunits of 70 kDa and 55 kDa, respectively. Acetyl-CoA is the precursor for fatty acid biosynthesis in plastids of plants. Since Acetyl-CoA does not cross the membranes of subcellular compartments, it must be synthesized inside plastids. While the origin of plastid Acetyl-CoA has been subject of much speculation in plant fatty acid biosynthesis, in animals, fungi and yeast, acetyl-CoA is formed from citrate generated in the mitochondria and exported to the cytosol via a tricarbolxylic acid transporter and converted to acetyl-CoA by cytosolic ACL. It has been proposed that ACL is associated in part with the plastids of different plant species (Rangasamy and Ratledge (2000) *Plant Physiol* 122:1225–1230). In addition it has been shown that ACL activity increases concomitantly with oil biosynthesis during seed development in oilseed rape (Ratledge et al (1997) *Lipids* 32: 7–12). This suggests that ACL activity might regulate the rate of plant fatty acid synthesis by controlling the rate at which acetyl-CoA is provided for ACCase, similar to what occurs with oleaginous yeasts (Evans and Ratledge (1985) *Biotech Genet Eng Rev* 3: 349–375). Only recently, researchers were able to successfully overexpress the rat liver ACL in Tobacco leave plastids, with a concomitant increase in total fatty acids (Rangasamy and Ratledge (2000) *Plant Physiol* 122:1231–1238).

Hereupon overexpression of ACL in plastid of plants, the side of de novo fatty acid biosynthesis in plants, may lead to an increase in fatty acid content in the target tissue, in particular when targeted to an oil producing tissue such as the seed.

Recently a group of proteins, caleosins, which contain an N-terminal region with a single Ca+2 binding EF-hand domain, a central hydrophobic region with a potential membrane anchor, and a C-terminal region with conserved protein kinase phosphorylation sites was identified in plants (Naestadt et al (2000) *Plant Mol Biol* 44: 463–476). Proteins with a single EF-hand are rare among the EF-hand proteins described to date. In most of them, EF-hands are paired to promote cooperative, high affinity binding of two calcium ions within the hydrophobic pocket formed by both sites. Most EF-hand proteins are either soluble in the cytosol or on membranes facing the cytosol, a few are present within the lumen of organelles in the secretory pathway (Ikura (1996) *Trends in Biochem. Sci.* 26: 14–17. Lin et al (1998) *J Cell Biol* 141: 1515–1527). Unlike these, caleosins do not have a N-terminal signal peptide, but include a central hydrophobic region with the potential to form a transmembrane helix (Frandsen et al (1996) *J Biol Chem* 271: 343–348). Caleosin have been found to be associated with the oil-bodies, similar to oleosins, and also appear to be associated with an ER subdomain at the early stages of embryo development in Arabidopsis, when storage oil-body and storage protein formation commence. Caleosins are encoded by multigene families in plants and have been identified in a variety of plant species (Chen et al (1998) *Plant Cell Physiol* 39: 935–941. Nuccio and Thomas (1999) *Plant Mol Biol* 39:1153–1163.). The possible participation of caleosin in processes associated with formation of the ER subdomain, where oil-bodies are formed makes it an attractive candidate for attempting to increase oil content in plants.

Lec1 homologs may be further identified by using conserved sequence motifs. The following amino acid sequence (given in single letter code, with "x" representing any amino acid). Under lined amino acids are those that are conserved in Lec1 but not found in Lec1-related proteins.

REQDxxMPxANVxRIMRxxLPxxAKISDDAKEx
IQECVSExISFxTxEANxRCxxxx RKTxxxE

In a further embodiment, this invention encompasses chimeric construct comprising any of the isolated nucleic acid fragments of the invention or complement thereof operably linked to at least one regulatory sequence. It is also understood that chimeric constructs comprising such fragments or complements thereof or parts of either can be used in antisense inhibition or suppression of a transformed plant.

Also within the scope of this invention is a plant comprising in its genome a chimeric construct as described herein. Chimeric constructs designed for plant expression such as those described herein can be introduced into a plant cell in a number of art-recognized ways. Those skilled in the art will appreciate that the choice of method might depend on the type of plant (i.e, monocot or dicot) and/or organelle (i.e., nucleus, chloroplast, mitochondria) targeted for transformation. Suitable methods for transforming plant cells include microinjection, electroporation, Agrobacterium mediated transformation, direct gene transfer and particle-accelerated or "gene gun" transformation technology as is discussed above.

Examples of plants which can be transformed include, but are not limited to, corn, soybean, wheat, rice, canola, Brassica, sorghum, sunflower, and coconut.

The regeneration, development and cultivation of plants from single plant protoplast transformants or from various transformed explants is well known in the art (Weissbach and Weissbach, In, Methods for Plant Molecular Biology, (Eds.), Academic Press, Inc., San Diego, Calif. (1988)). This regeneration and growth process typically includes the steps of selection of transformed cells, culturing those individualized cells through the usual stages of embryonic development through the rooted plantlet stage. Transgenic embryos and seeds are similarly regenerated. The resulting transgenic rooted shoots are thereafter planted in an appropriate plant growth medium such as soil.

The development or regeneration of plants containing the foreign, exogenous gene that encodes a protein of interest is well known in the art. Preferably, the regenerated plants are self-pollinated to provide homozygous transgenic plants. Otherwise, pollen obtained from the regenerated plants is crossed to seed-grown plants of agronomically important lines. Conversely, pollen from plants of these important lines is used to pollinate regenerated plants. A transgenic plant of the present invention containing a desired polypeptide is cultivated using methods well known to one skilled in the art.

There are a variety of methods for the regeneration of plants from plant tissue. The particular method of regeneration will depend on the starting plant tissue and the particular plant species to be regenerated. Methods for transforming dicots, primarily by use of *Agrobacterium tumefaciens,* and obtaining transgenic plants have been published for cotton (U.S. Pat. No. 5,004,863, U.S. Pat. No. 5,159,135, U.S. Pat. No. 5,518,908); soybean (U.S. Pat. No. 5,569,834, U.S. Pat. No. 5,416,011, McCabe et. al., *Bio/Technology* 6:923 (1988), Christou et al., *Plant Physiol.* 87:671–674 (1988)); *Brassica* (U.S. Pat. No. 5,463,174); peanut (Cheng et al., *Plant Cell Rep.* 15:653–657 (1996), McKently et al., *Plant Cell Rep.* 14:699–703 (1995)); papaya; and pea (Grant et al., *Plant Cell Rep.* 15:254–258, (1995)).

Transformation of monocotyledons using electroporation, particle bombardment, and *Agrobacterium* have also been reported. Transformation and plant regeneration have been achieved in asparagus (Bytebier et al., *Proc. Natl. Acad. Sci.* (USA) 84:5354, (1987)); barley (Wan and Lemaux, *Plant Physiol* 104:37 (1994)); *Zea mays* (Rhodes et al., *Science* 240:204 (1988), Gordon-Kamm et al., *Plant Cell* 2:603–618 (1990), Fromm et al., *Bio/Technology* 8:833 (1990), Koziel et al., *Bio/Technology* 11: 194, (1993), Armstrong et al., *Crop Science* 35:550–557 (1995)); oat (Somers et al., *Bio/Technology* 10: 15 89 (1992)); orchard grass (Horn et al., *Plant Cell Rep.* 7:469 (1988)); rice (Toriyama et al., *TheorAppl. Genet.* 205:34, (1986); Part et al., *Plant Mol. Biol.* 32:1135–1148, (1996); Abedinia et al., *Aust. J. Plant Physiol.* 24:133–141 (1997); Zhang and Wu, *Theor. Appl. Genet.* 76:835 (1988); Zhang et al. *Plant Cell Rep.* 7:379, (1988); Battraw and Hall, *Plant Sci.* 86:191–202 (1992); Christou et al., *Bio/Technology* 9:957 (1991)); rye (De la Pena et al., *Nature* 325:274 (1987)); sugarcane (Bower and Birch, *Plant J.* 2:409 (1992)); tall fescue (Wang et al., *Bio/Technology* 10:691 (1992)), and wheat (Vasil et al., *Bio/Technology* 10:667 (1992); U.S. Pat. No. 5,631,152).

Assays for gene expression based on the transient expression of cloned nucleic acid constructs have been developed by introducing the nucleic acid molecules into plant cells by polyethylene glycol treatment, electroporation, or particle bombardment (Marcotte et al., *Nature* 335:454–457 (1988);

Marcotte et al., *Plant Cell* 1:523–532 (1989); McCarty et al., *Cell* 66:895–905 (1991); Hattori et al., *Genes Dev.* 6:609–618 (1992); Goff et al., *EMBO J.* 9:2517–2522 (1990)).

Transient expression systems may be used to functionally dissect gene constructs (see generally, Maliga et al., Methods in Plant Molecular Biology, Cold Spring Harbor Press (1995)). It is understood that any of the nucleic acid molecules of the present invention can be introduced into a plant cell in a permanent or transient manner in combination with other genetic elements such as vectors, promoters, enhancers etc.

In addition to the above discussed procedures, practitioners are familiar with the standard resource materials which describe specific conditions and procedures for the construction, manipulation and isolation of macromolecules (e.g., DNA molecules, plasmids, etc.), generation of recombinant organisms and the screening and isolating of clones, (see for example, Sambrook et al., Molecular Cloning: A Laboratory Manual, Cold Spring Harbor Press (1989); Maliga et al., Methods in Plant Molecular Biology, Cold Spring Harbor Press (1995); Birren et al., Genome Analysis: Detecting Genes, 1, Cold Spring Harbor, N.Y. (1998); Birren et al., Genome Analysis: Analyzing DNA, 2, Cold Spring Harbor, N.Y. (1998); Plant Molecular Biology: A Laboratory Manual, eds. Clark, Springer, N.Y. (1997)).

Seeds obtained from such plants and oil obtained from these seeds constitute another aspect of the present invention.

In an even further aspect, the invention concerns a method for altering oil phenotype in a plant which comprises:

(a) transforming a plant with a chimeric construct of the invention;

(b) growing the transformed plant under conditions suitable for expression of the chimeric gene; and (c) selecting those transformed plants whose oil phenotype has been altered compared to the oil phenotype of an untransformed plant.

In a more specific embodiment, the invention concerns a method for altering oil phenotype in a plant which comprises:

(a) transforming a plant with a chimeric construct comprising isolated nucleotide fragment comprising a nucleic acid sequence selected from the group consisting of:

(i) a nucleic acid sequence encoding a plant SNF1 protein kinase having at least 60% identity based on the Clustal method of alignment when compared to a second polypeptide selected from the group consisting of even SEQ ID NOs: from 234 to 258 and SEQ ID NOs: 400–409;

(ii) the complement of the nucleic acid sequence of (i);

(iii) the sequence of (i) or (ii) or a part thereof which is useful in antisense inhibition or co-suppression in a transformed plant;

(iv) a nucleic acid sequence encoding a plant Hap3/Lec1 transcription factor having at least 60% identity based on the Clustal method of alignment when compared to a second polypeptide selected from the group consisting of even SEQ ID NOs: from 260 to 278, and SEQ ID NOs: 411–412;

(v) the complement of the nucleic acid sequence of (iv);

(vi) the sequence of (iv) or (v) or a part thereof which is useful in antisense inhibition or co-suppression in a transformed plant;

(vii) a nucleic acid sequence encoding a plant Lec1-related CCAAT binding transcription factor having at least 60% identity based on the Clustal method of alignment when compared to a second polypeptide selected from the group consisting of even SEQ ID NOs: from 280 to 308, and SEQ ID NOs: 413–418;

(viii) the complement of the nucleic acid sequence of (vii);

(ix) the sequence of (vii) or (viii) or a part thereof which is useful in antisense inhibition or co-suppression in a transformed plant;

(x) a nucleic acid sequence encoding a plant Aintegumenta-like transcription factor having at least 60% identity based on the Clustal method of alignment when compared to a second polypeptide selected from the group consisting of even SEQ ID NOs: from 310 to 364, and SEQ ID NO: 419–429;

(xi) the complement of the nucleic acid sequence of (x);

(xii) the sequence of (x) or (xi) or a part thereof which is useful in antisense inhibition or co-suppression in a transformed plant;

wherein said nucleic acid sequence is operably linked to at least one regulatory sequence;

(b) growing the transformed plant under conditions suitable for expression of the chimeric gene; and (c) selecting those transformed plants whose oil phenotype has been altered compared to the oil phenotype of an untransformed plant.

It is understood by one skilled in the art that other percent identity ranges may be useful in the above mentioned method. Useful percent identities would include, but not be limited to, 45%, 55%, 60%, 65%, 70%, 75%, 80%, 85%, 90%, 95% and all integer percentages from 45 to 100%.

In an even further aspect, this invention concerns a method to isolate nucleic acid fragments associated with altering oil phenotype in a plant which comprises:

(a) comparing even SEQ ID NOs: from 2 to 364, and SEQ ID NOs: 365–429 and 528–532, and all odd SEQ ID NOs: from 477 to 527 with other polypeptide sequences for the purpose of identifying polypeptides associated with altering oil phenotype in a plant;

(b) identifying the conserved sequences(s) or 4 or more amino acids obtained in step (a);

(c) making region-specific nucleotide probe(s) or oligomer(s) based on the conserved sequences identified in step (b); and (d) using the nucleotide probe(s) or oligomer(s) of step (c) to isolate sequences associated with altering oil phenotype by sequence dependent protocols.

In a most preferred aspect, this invention concerns a method for altering oil phenotype in a plant which comprises:

(a) transforming a plant with a chimeric construct comprising an isolated nucleic acid fragment operably linked to at least one regulatory sequence wherein said fragment has a nucleic acid sequence encoding a polypeptide having a sequence identity of at least 60% based on the Clustal method of alignment when compared to a polypeptide selected from the group consisting of even SEQ ID NOs: from 2 to 364, and SEQ ID NOs: 365–429 and 528–532, and all odd SEQ ID NOs: from 477 to 527;

(b) growing the transformed plant under conditions suitable for expression of the chimeric gene; and (c) selecting those transformed plants whose oil phenotype has been altered compared to the oil phenotype of an untransformed plant.

It is understood by one skilled in the art that other percent identity ranges may be useful in the above mentioned method. Useful percent identities would include, but not be limited to, 45%, 55%, 60%, 65%, 70%, 75%, 80%, 85%, 90%, 95% and all integer percentages from 45 to 100%.

In another aspect, this invention also concerns a method of mapping genetic variations related to altered oil phenotypes in a plant comprising:

(a) crossing two plant varieties; and
(b) evaluating genetic variations with respect to nucleic acid sequences set forth in the odd SEQ ID NOs: from 1 to 363, and in even SEQ ID NOs: from 476 to 526, in progeny plants resulting from the cross of step (a) wherein the evaluation is made using a method selected from the group consisting of: RFLP analysis, SNP analysis, and PCR-based analysis.

In another embodiment, this invention concerns a method of molecular breeding to obtain altered oil phenotypes in a plant comprising:

(a) crossing two plant varieties; and
(b) evaluating genetic variations with respect to nucleic acid sequences set forth in the odd SEQ ID NOs: from 1 to 363, and in even SEQ ID NOs: from 476 to 526, in progeny plants resulting from the cross of step (a) wherein the evaluation is made using a method selected from the group consisting of: RFLP analysis, SNP analysis, and PCR-based analysis.

The genetic variability at a particular locus (gene) due to even minor base changes can alter the pattern of restriction enzyme digestion fragments that can be generated. Pathogenic alterations to the genotype can be due to deletions or insertions within the gene being analyzed or even single nucleotide substitutions that can create or delete a restriction enzyme recognition site. RFLP analysis takes advantage of this and utilizes Southern blotting with a probe corresponding to the gene of interest.

Thus, if a polymorphism (i.e., a commonly occurring variation in a gene or segment of DNA; also, the existence of several forms of a gene (alleles) in the same species) creates or destroys a restriction endonuclease cleavage site, or if it results in the loss or insertion of DNA (e.g., a variable nucleotide tandem repeat (VNTR) polymorphism), it will alter the size or profile of the DNA fragments that are generated by digestion with that restriction endonuclease. As such, individuals that possess a variant sequence can be distinguished from those having the original sequence by restriction fragment analysis. Polymorphisms that can be identified in this manner are termed "restriction fragment length polymorphisms: ("RFLPs"). RFLPs have been widely used in human and plant genetic analyses (Glassberg, UK Patent Application 2135774; Skolnick et al, Cytogen. Cell Genet. 32:58–67 (1982); Botstein et al, Ann. J. Hum. Genet. 32:314–331 (1980); Fischer et al (PCT Application WO 90/13668; Uhlen, PCT Application WO 90/11369).

A central attribute of "single nucleotide polymorphisms" or "SNPs" is that the site of the polymorphism is at a single nucleotide. SNPs have certain reported advantages over RFLPs or VNTRs. First, SNPs are more stable than other classes of polymorphisms. Their spontaneous mutation rate is approximately $10^{-9}$ (Kornberg, DNA Replication, W. H. Freeman & Co., San Francisco, 1980), approximately, 1, 000 times less frequent than VNTRs (U.S. Pat. No. 5,679,524). Second, SNPs occur at greater frequency, and with greater uniformity than RFLPs and VNTRs. As SNPs result from sequence variation, new polymorphisms can be identified by sequencing random genomic or cDNA molecules. SNPs can also result from deletions, point mutations and insertions. Any single base alteration, whatever the cause, can be a SNP. The greater frequency of SNPs means that they can be more readily identified than the other classes of polymorphisms.

SNPs can be characterized using any of a variety of methods. Such methods include the direct or indirect sequencing of the site, the use of restriction enzymes where the respective alleles of the site create or destroy a restriction site, the use of allele-specific hybridization probes, the use of antibodies that are specific for the proteins encoded by the different alleles of the polymorphism or by other biochemical interpretation. SNPs can be sequenced by a number of methods. Two basic methods may be sued for DNA sequencing, the chain termination method of Sanger et al, Proc. Natl. Acad. Sci. (U.S.A.) 74:5463–5467 (1977), and the chemical degradation method of Maxam and Gilbert, Proc. Natl. Acad. Sci. (U.S.A.) 74: 560–564 (1977).

Polymerase chain reaction ("PCR") is a powerful technique used to amplify DNA millions of fold, by repeated replication of a template, in a short period of time. (Mullis et al, Cold Spring Harbor Symp. Quant. Biol. 51:263–273 (1986); Erlich et al, European Patent Application 50, 424; European Patent Application 84, 796; European Patent Application 258, 017, European Patent Application 237, 362; Mullis, European Patent Application 201, 184, Mullis et al U.S. Pat. No. 4,683,202; Erlich, U.S. Pat. No. 4,582, 788; and Saiki et al, U.S. Pat. No. 4,683,194). The process utilizes sets of specific in vitro synthesized oligonucleotides to prime DNA synthesis. The design of the primers is dependent upon the sequences of DNA that are desired to be analyzed. The technique is carried out through many cycles (usually 20–50) of melting the template at high temperature, allowing the primers to anneal to complementary sequences within the template and then replicating the template with DNA polymerase.

The products of PCR reactions are analyzed by separation in agarose gels followed by ethidium bromide staining and visualization with UV transillumination. Alternatively, radioactive dNTPs can be added to the PCR in order to incorporate label into the products. In this case the products of PCR are visualized by exposure of the gel to x-ray film. The added advantage of radiolabeling PCR products is that the levels of individual amplification products can be quantitated.

Furthermore, single point mutations can be detected by modified PCR techniques such as the ligase chain reaction ("LCR") and PCR-single strand conformational polymorphisms ("PCR-SSCP") analysis. The PCR technique can also be sued to identify the level of expression of genes in extremely small samples of material, e.g., tissues or cells from a body. The technique is termed reverse transcription-PCR ("RT-PCR").

In another embodiment, this invention concerns a method for altering oil phenotype in a plant which comprises:

(a) transforming a plant with a chimeric construct comprising isolated nucleotide fragment comprising a nucleic acid sequence selected from the group consisting of:

(i) a nucleic acid sequence encoding a plant Hap3/Lec1 transcription factor having at least 70% identity based on the Clustal method of alignment when compared to a second polypeptide selected from the group consisting of SEQ ID NOs: 260, 262, 264, 268, 270, 272, 274, 276, 278, 411, 412. or 459;
(ii) the complement of the nucleic acid sequence of (iv);
(iii) the sequence of (iv) or (v) or a part thereof which is useful in antisense inhibition or co-suppression in a transformed plant;

(b) growing the transformed plant under conditions suitable for expression of the chimeric gene; and (c) selecting those transformed plants whose oil phenotype has been altered compared to the oil phenotype of an untransformed plant.

It is understood by one skilled in the art that other percent identity ranges may be useful in the above mentioned method. Useful percent identities would include, but not be limited to, 45%, 50%, 55%, 60%, 65%, 75%, 80%, 85%, 90%, 95% and all integer percentages from 45 to 100%.

In another aspect this invention concerns a method to isolate nucleic acid fragments associated with altering oil phenotype in a plant which comprises:

(a) comparing SEQ ID NOs: 260, 262, 264, 268, 270, 272, 274, 276, 278, 411, 412. or 459 with other polypeptide sequences for the purpose of identifying polypeptides associated with altering oil phenotype in a plant;

(b) identifying the conserved sequences(s) or 4 or more amino acids obtained in step (a);

(c) making region-specific nucleotide probe(s) or oligomer(s) based on the conserved sequences identified in step (b); and (d) using the nucleotide probe(s) or oligomer(s) of step (c) to isolate sequences associated with altering oil phenotype by sequence dependent protocols.

EXAMPLES

The present invention is further defined in the following Examples, in which parts and percentages are by weight and degrees are Celsius, unless otherwise stated. The disclosure of each reference set forth herein is incorporated herein by reference in its entirety.

Example 1

Composition of cDNA Libraries; Isolation and Sequencing of cDNA Clones cDNA libraries representing mRNAs from various plant tissues were prepared. The characteristics of the libraries are described below.

TABLE 2 cDNA Libraries from Various Plants

| Library | Tissue | Clone |
|---|---|---|
| cbn 10 | Corn Developing Kernel (Embryo and Endosperm); 10 Days After Pollination | cbn10.pk0005.e6:fis<br>cbn10.pk0064.e6 |
| cc71se-a | Corn Callus Type II Tissue, Somatic Embryo Formed | cc71se-a.pk0002.e11:fis |
| cc71se-b | Corn Callus Type II Tissue, Somatic Embryo Formed | cc71se-b.pk0018.e4:fis |
| cca | Corn Callus Type II Tissue, Undifferentiated, Highly Transformable | cca.pk0026.d6 |
| ccase-b | Corn Callus Type II Tissue, Somatic Embryo Formed, Highly Transformable | ccase-b.pk0003.b9:fis |
| cco1n | Corn Cob of 67 Day Old Plants Grown in Green House* | cco1n.pk062.j7<br>cco1n.pk086.d20:fis<br>cco1n.pk0014.d4:fis<br>cco1n.pk055.o18<br>cco1n.pk089.g17<br>cco1n.pk068.f18:fis |
| cde1c | Corn (*Zea Mays*, B73) developing embryo 20 dap | cde1c.pk003.o22:fis |
| cde1n | Corn (*Zea mays*, B73) developing embryo 20 DAP normalized | cde1n.pk003.a5<br>cde1n.pk001.n24:fis |
| cdo1c | Corn (*Zea Mays* L.) ovary, 5 days after silking (includes pedicel and glumes) | cdo1c.pk001.c1:fis |
| ceb3 | Corn Embryo 20 Days After Pollination | ceb3.pk0012.a7 |
| ceb5 | Corn Embryo 30 Days After Pollination | ceb5.pk0081.b4 |
| cen3n | Corn Endosperm 20 Days After Pollination* | cen3n.pk0164.a10<br>cen3n.pk0044.b8:fis<br>cen3n.pk0112.e10:fis |
| cho1c | Corn (*Zea mays* L., Alexho Synthetic High Oil) embryo 20 DAP | cho1c.pk003.p17:fis<br>cho1c.pk003.n23<br>cho1c.pk004.b19:fis<br>cho1c.pk007.l21:fis<br>cho1c.pk001.l23:fis<br>cho1c.pk009.g10 |
| clm1f | Corn (*Zea mays*, B73) leaf at V6-VT (full length) | clm1f.pk001.k17<br>clm1f.pk002.o13:fis |
| cpd1c | Corn (*Zea mays* L.) pooled BMS treated with chemicals related to protein kinases | cpd1c.pk011.i5:fis<br>cpd1c.pk008.e21 |
| cpf1c | Corn (*Zea Mays* L.) pooled BMS treated with chemicals related to protein synthesis | cpf1c.pk006.e3:fis |
| cpj1c | Corn (*Zea Mays* L.) pooled BMS treated with chemicals related to membrane ionic force | cpj1c.pk005.m20:fis |
| cr1n | Corn Root From 7 Day Old Seedlings* | cr1n.pk0080.g6 |
| cse1c | Corn (*Zea Mays* L.) seedling at V2 stage treated with Ethylene collected at 6 hr, 23 hr, 72 hr | cse1c.pk001.h6 |

TABLE 2-continued cDNA Libraries from Various Plants

| Library | Tissue | Clone |
|---|---|---|
| ctaln | Corn Tassel* | ctaln.pk0070.f3:fis |
| | | ctaln.pk0074.h11 |
| ctn1c | Corn (*Zea Mays* L., B73) night harvested tassel (v12 stage). | ctn1c.pk002.o4 |
| ece1c | castor bean developing endosperm to compare/contrast triacylglycerol biosynthesis | ece1c.pk003.g23:fis |
| ect1c | *Canna edulis* Tubers | ect1c.pk001.k17:fis |
| | | ect1c.pk007.p18:fis |
| eef1c | Eucalyptus tereticornis flower buds from adult tree | eef1c.pk004.c8:fis |
| egh1c | Upland Cotton (*Gossypium hirsutum*) germinating seeds, to identify cDNAs associated with N-acyl-phosphatidylethanolamine synthesis | egh1c.pk005.k20 |
| etr1c | Cattail (*Typha latifolia*) root | etr1c.pk006.f9 |
| fds | *Momordica charantia* Developing Seed | fds.pk0003.h5:fis |
| | | fds1n.pk015.l15 |
| hss1c | *Sclerotinia* infected sunflower plants | hss1c.pk011.h10:fis |
| ncs | *Catalpa speciosa* Developing Seed | ncs.pk0013.c4 |
| p0006 | Young shoot | p0006.cbysa51r:fis |
| p0015 | 13 DAP embryo | p0015.cdpgu90r:fis |
| | | p0015.cdpfm55r:fis |
| p0016 | Tassel shoTassel shoots, pooled, 0.1–1.4 cm | p0016.ctsbf56rb |
| p0018 | Seedling after 10 day drought (T001), heat shocked for 24 hrs (T002), recovery at normal growth condition for 8 hrs, 16 hrs, 24 hrs | p0018.chssh26r |
| p0026 | Regenerating callus 5 days after auxin removal Hi-II callus 223a, 1129e | p0026.ccrab39r |
| p0027 | GS3 shoot cultures that were transformed with PHP5869 and were maintained on 273T shoot multiplication medium since Mar. 17, 1994 (sample received on May 29, 1996 for RNA prep). The original transformation was done on Nov. 6, 1993 | p0027.cgsag51r |
| p0031 | CM45 shoot culture. It was initiated on Feb. 28, 1996 from seed derived meristems. The culture was maintained on 273N medium. | p0031.ccmau15r:fis |
| | | p0031.ccmbc81r |
| p0032 | Regenerating callus, 10 and 14 days after auxin removal. Hi-II callus 223a, 1129e 10 days. Hi-II callus 223a, 1129e 14 days | p0032.crcav77r:fis |
| p0037 | corn Root Worm infested V5 roots | p0037.crwbs90r:fis |
| p0083 | 7 DAP whole kernels | p0083.cldct11r:fis |
| | | p0083.cldeu68r:fis |
| | | p0083.clder12r |
| p0086 | P0067 screened 1; 11 DAP pericarp | p0086.cbsaa24r |
| p0118 | Night harvested, pooled stem tissue from the 4–5 internodes subtending the tassel; V8–V12 stages, Screened 1 | p0118.chsbc77r |
| | | p0118.chsbh89r |
| p0125 | Anther: Prophase I sceened 1 | p0125.czaab60rb:fis |
| p0126 | Night harvested leaf tissue; V8–V10 | p0126.cnlau71r:fis |
| p0134 | Hi-II callus 223a, 1129e, 10 days hi-II callus 233a, 1129e, 14 days | p0134.carah47r |
| pps1c | Prickly poppy developing seeds | pps1c.pk001.h3:fis |
| | | pps1c.pk007.j21:fis |
| rbm5c | Rice (*Oryza sativa*, Cypress) bran 10 days after milling | rbm5c.pk001.a19 |
| rca1c | Rice *Nipponbare* Callus. | rca1c.pk007.b22:fis |
| rca1n | Rice (*Oryza sativa* L., *Nipponbare*) callus normalized. | rca1n.pk029.n22 |
| | | rca1n.pk002.j3 |
| | | rca1n.pk021.b20:fis |
| | | rca1n.pk004.j14:fis |
| | | rca1n.pk026.m9 |
| | | rca1n.pk008.o5:fis |
| rl0n | Rice 15 Day Old Leaf* | rl0n.pk096.h23 |
| | | rl0n.pk0061.c8:fis |
| | | rl0n.pk131.j17 |
| | | rl0n.pk0015.a4:fis |
| rlm3n | Rice (*Oryza Sativa*, YM) leaf mixture (rsr9) normalized at 45 C for 24 hrs using 20 fold excess of driver | rlm3n.pk005.d20:fis |
| rlr2 | Rice (*Oryza sativa* L.) leaf (15 DAG) 2 hrs after infection of strain 4360-R-62 (AVR2-YAMO); Resistant | rlr2.pk0012.d2 |

TABLE 2-continued cDNA Libraries from Various Plants

| Library | Tissue | Clone |
|---|---|---|
| rlr24 | Rice Leaf 15 Days After Germination, 24 Hours After Infection of Strain *Magnaporthe grisea* 4360-R-62 (AVR2-YAMO); Resistant | rlr24.pk0032.e10 |
| rls6 | Rice Leaf 15 Days After Germination, 6 Hours After Infection of Strain *Magnaporthe grisea* 4360-R-67 (AVR2-YAMO); Susceptible | rls6.pk0033.a9:fis |
| rls72 | Rice Leaf 15 Days After Germination, 72 Hours After Infection of Strain *Magnaporthe grisea* 4360-R-67 (AVR2-YAMO); Susceptible | rls72.pk0023.c8:fis |
| rr1 | Rice Root of Two Week Old Developing Seedling | rr1.pk0039.d4:fis<br>rr1.pk0003.a3:fis<br>rr1.pk097.f22:fis<br>rr1.pk0047.g12:fis |
| rsl1n | Rice (*Oryza sativa*, YM) 15 day old seedling normalized | rsl1n.pk002.g10:fis<br>rsl1n.pk002.j2:fis<br>rsl1n.pk006.n24:fis<br>rsl1n.pk013.g2 |
| scb1c | Soybean (Glycine max L., 2872) Embryogenic suspension culture subjected to 4 bombardments and collected 12 hrs later. | scb1c.pk004.n19:fis |
| sde4c | Soybean Developing Embryo (9–11 mm) | sde4c.pk0001.a2:fis |
| sdp2c | Soybean (Glycine max L.) developing pods 6–7 mm | sdp2c.pk003.o5:fis<br>sdp2c.pk023.n6:fis<br>sdp2c.pk029.k17:fis<br>sdp2c.pk044.e5:fis |
| sdp3c | Soybean Developing Pods (8–9 mm) | sdp3c.pk018.b9:fis<br>sdp3c.pk019.n1:fis |
| sdp4c | Soybean (Glycine max L.) developing pods 10–12 mm | sdp4c.pk009.e3<br>sdp4c.pk016.e10 |
| sdr1f | Soybean (Glycine max, Wye) 10 day old root | sdr1f.pk001.p7 |
| sds1f | Soybean (Glycine max, Wye) 11 day old seedling full length library using trehalose | sds1f.pk001.f7:fis |
| se1 | Soybean Embryo, 6 to 10 Days After Flowering | se1.pk0042.d8:fis |
| se2 | Soybean Embryo, 13 Days After Flowering | se2.11d12:fis |
| se3 | Soybean (Glycine max L.) embryo, 17 DAF | se3.pk0034.a3 |
| ses2w | Soybean Embryogenic Suspension 2 Weeks After Subculture | ses2w.pk0015.a4:fis<br>ses2w.pk0035.a9:fis<br>ses2w.pk0012.d10:fis |
| ses4d | Soybean Embryogenic Suspension 4 Days After Subculture | ses4d.pk0037.e3:fis<br>ses4d.pk0044.c12<br>ses4d.pk0006.a12<br>ses4d.pk0006.a12:fis<br>ses4d.pk0043.d10:fis |
| sfl1 | Soybean Immature Flower | sfl1.pk0102.h8<br>sfl1.pk131.j19<br>sfl1.pk135.g3<br>sfl1.pk0029.h10:fis |
| sgc5c | Soybean (*Glycine max* L., Wye) germanating cotyledon (3/4 yellow; 15–24 DAG) | sgc5c.pk001.h16 |
| sgs1c | Soybean Seeds 4 Hours After Germination | sgs1c.pk004.f19:fis |
| sgs4c | Soybean (*Glycine max* L.) seeds 2 days after germination. | sgs4c.pk004.j2<br>sgs4c.pk006.g6<br>sgs4c.pk006.n21 |
| sic1c | Soybean (*Glycine max*) pooled tissue of root, stem, and leaf with iron chlorosis conditions | sic1c.pk003.o13:fis<br>sic1c.pk003.o18:fis |
| sif1c | Soybean (*Glycine max*) pooled tissue of basal stem and root infected with fusarium | sif1c.pk001.m16:fis |
| sls1c | Soybean (*Glycine max* L., S1990) infected with *Sclerotinia sclerotiorum* mycelium. | sls1c.pk010.l1:fis<br>sls1c.pk032.j4 |
| sls1c | Soybean (*Glycine max* L., S1990) infected with *Sclerotinia sclerotiorum* mycelium. | sls1c.pk010.l1:fis<br>sls1c.pk020.h24 |
| sls2c | Soybean (*Glycine max* L., Manta) infected with *Sclerotinia sclerotiorum* mycelium. | sls2c.pk007.c23:fis |
| sr1 | Soybean Root | sr1.pk0041.a11:fis<br>sr1.pk0049.c2 |
| srb | Scarlett runner bean (R.Goldberg) | srb.08g04 |
| src1c | Soybean 8 Day Old Root Infected With Cyst Nematode | src1c.pk003.o16:fis |
| src2c | Soybean (*Glycine max* L., 437654) 8 day old root inoculated with eggs of cyst Nematode (Race 1) for 4 days. | src2c.pk025.b3:fis<br>src2c.pk011.m12:fis<br>src2c.pk009.g9:fis<br>src2c.pk003.i13:fis |

TABLE 2-continued cDNA Libraries from Various Plants

| Library | Tissue | Clone |
|---|---|---|
| src3c | Soybean 8 Day Old Root Infected With Cyst Nematode | src3c.pk018.d10:fis<br>sr3c.pk011.g22<br>src3c.pk012.m6:fis<br>src3c.pk019.d4:fis<br>src3c.pk009.b15<br>src3c.pk028.j21:fis |
| sre | Soybean (*Glycine max* L.) root elongation | sre.pk0037.c1 |
| srr1c | Soybean 8-Day-Old Root | srr1c.pk001.i24:fis |
| srr3c | Soybean 8-Day-Old Root | srr3c.pk001.l10:fis |
| tlw1c | Tobacco (*Nicotiana benthamiana*) Leaves Wounded by Abrasion and Harvested After 1.5 Hour. | tlw1c.pk006.o16 |
| vdb1c | Grape (*Vitis* sp.) developing bud | vdb1c.pk001.m5:fis |
| vmb1na | Grape (*Vitis* sp.) midstage berries normalized | vmb1na.pk015.d18:fis |
| vpl1c | Grape (*Vitis* sp.) In vitro plantlets | vpl1c.pk008.o5:fis |
| vrr1c | Grape (*Vitis* sp.)resistant roots | vrr1c.pk004.o20:fis |
| vs1n | Vernonia Seed* | vs1n.pk013.m13:fis |
| wde1f | Wheat (*Triticum aestivum*, Hi Line) developing endosperm 2–7 DPA | wde1f.pk003.h2:fis |
| wdk2c | Wheat Developing Kernel, 7 Days After Anthesis. | wdk2c.pk009.e4 |
| wdk2c | Wheat Developing Kernel, 7 Days After Anthesis. | wdk2c.pk018.c16:fis |
| wdk3c | Wheat Developing Kernel, 14 Days After Anthesis. | wdk3c.pk023.h15:fis |
| wdk5c | Wheat Developing Kernel, 30 Days After Anthesis | wdk5c.pk006.m13 |
| wdk9n | Wheat (*Triticum aestivu*, Spring Wheat) kernels 3, 7, 14 and 21 days after anthesis | wdk9n.pk001.k5 |
| wdr1f | Wheat (*Triticum aestivum*) developing root (full length) | wdr1f.pk003.b21:fis |
| wds1f | Wheat developing seedling full length | wds1f.pk002.p21:fis |
| wia1c | Wheat (*Triticum aestivum*, Hi Line) immature anthers | wia1c.pk001.d20:fis |
| wkm1c | Wheat Kernel malted 55 Hours at 22 Degrees Celsius | wkm1c.pk0002.d7:fis |
| wl1n | Wheat Leaf From 7 Day Old Seedling* | wl1n.pk0114.f9 |
| wle1n | Wheat Leaf From 7 Day Old Etiolated Seedling* | wle1n.pk0076.h7:fis |
| wlk8 | Wheat Seedlings 8 Hours After Treatment With Fungicide** | wlk8.pk0001.e10:fis<br>wlm96.pk060.d5 |
| wlm96 | Wheat Seedlings 96 Hours After Inoculation With *Erysiphe graminis* f. sp *tritici* | wlm96.pk037.k9:fis<br>wlm96.pk035.j11:fis<br>wlm96.pk0007.e4:fis<br>wr1.pk0094.f2:fis |
| wr1 | Wheat Root From 7 Day Old Seedling | wr1.pk0153.c7:fis<br>wr1.pk148.f7:fis |
| wre1n | Wheat Root From 7 Day Old Etiolated Seedling* | wre1n.pk0066.e4:fis<br>wre1n.pk0143.h2:fis |

*These libraries were normalized essentially as described in U.S. Pat. No. 5,482,845, incorporated herein by reference.
**Application of 6-iodo-3-propyl-2-propyloxy-4(3H)-quinazolinone; synthesis and methods of using this compound are described in U.S. Pat. No. 5,747,497.

cDNA libraries may be prepared by any one of many methods available. For example, the cDNAs may be introduced into plasmid vectors by first preparing the cDNA libraries in Uni-ZAP™ XR vectors according to the manufacturer's protocol (Stratagene Cloning Systems, La Jolla, Calif.). The Uni-ZAP™ XR libraries are converted into plasmid libraries according to the protocol provided by Stratagene. Upon conversion, cDNA inserts will be contained in the plasmid vector pBluescript. In addition, the cDNAs may be introduced directly into precut Bluescript II SK(+) vectors (Stratagene) using T4 DNA ligase (New England Biolabs), followed by transfection into DH10B cells according to the manufacturer's protocol (GIBCO BRL Products). Once the cDNA inserts are in plasmid vectors, plasmid DNAs are prepared from randomly picked bacterial colonies containing recombinant pBluescript plasmids, or the insert cDNA sequences are amplified via polymerase chain reaction using primers specific for vector sequences flanking the inserted cDNA sequences. Amplified insert DNAs or plasmid DNAs are sequenced in dye-primer sequencing reactions to generate partial cDNA sequences (expressed sequence tags or "ESTs"; see Adams et al, (1991) *Science* 252:1651–1656). The resulting ESTs are analyzed using a Perkin Elmer Model 377 fluorescent sequencer.

Full-insert sequence (FIS) data is generated utilizing a modified transposition protocol. Clones identified for FIS are recovered from archived glycerol stocks as single colonies, and plasmid DNAs are isolated via alkaline lysis. Isolated DNA templates are reacted with vector primed M13 forward and reverse oligonucleotides in a PCR-based sequencing reaction and loaded onto automated sequencers. Confirmation of clone identification is performed by sequence alignment to the original EST sequence from which the FIS request is made.

Confirmed templates are transposed via the Primer Island transposition kit (PE Applied Biosystems, Foster City, Calif.) which is based upon the *Saccharomyces cerevisiae* Ty1 transposable element (Devine and Boeke (1994) *Nucleic Acids Res.* 22:3765–3772). The in vitro transposition system places unique binding sites randomly throughout a population of large DNA molecules. The transposed DNA is then used to transform DH10B electro-competent cells (Gibco BRL/Life Technologies, Rockville, Md.) via electroporation. The transposable element contains an additional selectable marker (named DHFR; Fling and Richards (1983) *Nucleic Acids Res* 11:5147–5158), allowing for dual selection on agar plates of only those subclones containing the integrated transposon. Multiple subclones are randomly selected from each transposition reaction, plasmid DNAs are prepared via alkaline lysis, and templates are sequenced (ABI Prism dye-terminator ReadyReaction mix) outward from the transposition event site, utilizing unique primers specific to the binding sites within the transposon.

Sequence data is collected (ABI Prism Collections) and assembled using Phred/Phrap (P. Green, University of Washington, Seattle). Phrep/Phrap is a public domain software program which re-reads the ABI sequence data, re-calls the bases, assigns quality values, and writes the base calls and quality values into editable output files. The Phrap sequence assembly program uses these quality values to increase the accuracy of the assembled sequence contigs. Assemblies are viewed by the Consed sequence editor (D. Gordon, University of Washington, Seattle).

In some of the clones the cDNA fragment corresponds to a portion of the 3'-terminus of the gene and does not cover the entire open reading frame. In order to obtain the upstream information one of two different protocols are used. The first of these methods results in the production of a fragment of DNA containing a portion of the desired gene sequence while the second method results in the production of a fragment containing the entire open reading frame. Both of these methods use two rounds of PCR amplification to obtain fragments from one or more libraries. The libraries some times are chosen based on previous knowledge that the specific gene should be found in a certain tissue and some times are randomly-chosen. Reactions to obtain the same gene may be performed on several libraries in parallel or on a pool of libraries. Library pools are normally prepared using from 3 to 5 different libraries and normalized to a uniform dilution. In the first round of amplification both methods use a vector-specific (forward) primer corresponding to a portion of the vector located at the 5'-terminus of the clone coupled with a gene-specific (reverse) primer. The first method uses a sequence that is complementary to a portion of the already known gene sequence while the second method uses a gene-specific primer complementary to a portion of the 3'-untranslated region (also referred to as UTR). In the second round of amplification a nested set of primers is used for both methods. The resulting DNA fragment is ligated into a pBluescript vector using a commercial kit and following the manufacturer's protocol. This kit is selected from many available from several vendors including Invitrogen (Carlsbad, Calif.), Promega Biotech (Madison, Wis.), and Gibco-BRL (Gaithersburg, Md.). The plasmid DNA is isolated by alkaline lysis method and submitted for sequencing and assembly using Phred/Phrap, as above.

Example 2

Identification of cDNA Clones cDNA clones encoding proteins involved in altering plant oil traits were identified by gene profiling (see Examples 6 and 8) and by conducting BLAST (Basic Local Alignment Search Tool; Altschul et al (1993) *J. Mol. Biol.* 215:403–410; see also www.ncbi.nlm.nih.gov/BLAST/) searches for similarity to sequences contained in the BLAST "nr" database (comprising all non-redundant GenBank CDS translations, sequences derived from the 3-dimensional structure Brookhaven Protein Data Bank, the last major release of the SWISS-PROT protein sequence database, EMBL, and DDBJ databases). The cDNA sequences obtained in Example 1 were analyzed for similarity to all publicly available DNA sequences contained in the "nr" database using the BLASTN algorithm provided by the National Center for Biotechnology Information (NCBI). The DNA sequences were translated in all reading frames and compared for similarity to all publicly available protein sequences contained in the "nr" database using the BLASTX algorithm (Gish and States (1993) *Nat. Genet.* 3:266–272) provided by the NCBI. For convenience, the P-value (probability) of observing a match of a cDNA sequence to a sequence contained in the searched databases merely by chance as calculated by BLAST are reported herein as "pLog" values, which represent the negative of the logarithm of the reported P-value. Accordingly, the greater the pLog value, the greater the likelihood that the cDNA sequence and the BLAST "hit" represent homologous proteins.

ESTs submitted for analysis are compared to the genbank database as described above. ESTs that contain sequences more 5- or 3-prime can be found by using the BLASTn algorithm (Altschul et al (1997) *Nucleic Acids Res.* 25:3389–3402.) against the DuPont proprietary database comparing nucleotide sequences that share common or overlapping regions of sequence homology. Where common or overlapping sequences exist between two or more nucleic acid fragments, the sequences can be assembled into a single contiguous nucleotide sequence, thus extending the original fragment in either the 5 or 3 prime direction. Once the most 5-prime EST is identified, its complete sequence can be determined by Full Insert Sequencing as described in Example 1. Homologous genes belonging to different species can be found by comparing the amino acid sequence of a known gene (from either a proprietary source or a public database) against an EST database using the tBLASTn algorithm. The tBLASTn algorithm searches an amino acid query against a nucleotide database that is translated in all 6 reading frames. This search allows for differences in nucleotide codon usage between different species, and for codon degeneracy.

Example 3

Characterization of cDNA Clones Encoding Proteins Involved in Altering Oil Phenotypes The BLASTX search using the EST sequences from clones listed in Table 3 revealed similarity of the polypeptides encoded by the cDNAs to receptor protein kinases, MEK3 homologs, Hap2 homologs, LIP 15 homologs, calcium EF-hand proteins, ATP citrate lyase, glucose metabolism proteins such as SNF1 homologs, Lec1 transcription factors, and seed developmentally regulated transcription factors such as CKC (Ainteguminata-like) homologs from various species including *Arabidopsis thaliana*, rice (*Oryza sativa*), corn (*Zea mays*), soybean (*Glycine max*), cucumber (*Cucumis sativus*), Sordaria (*Sordaria macrospora*), sesame (*Sesamum indicum*), grape (*Vitis sp.*), Brassica (*Brassica napus*), and tobacco (*Nicotiana tabacum*). Shown in Table 3 are the BLAST results for individual ESTs ("EST"), the sequences of the entire cDNA inserts comprising the indicated cDNA clones ("FIS"), the sequences of contigs assembled from two or more ESTs ("Contig"), sequences of contigs assembled from an FIS and one or more ESTs ("Contig*"), or sequences encoding an entire protein derived from an FIS, a contig, or an FIS and PCR ("CGS")

TABLE 3

BLAST Results for Sequences Encoding Polypeptides Homologous to Proteins Involved in Altering Oil Phenotypes

| SEQ ID NO. | Gene Name | Clone | Homolog | Genbank # | pLOG |
|---|---|---|---|---|---|
| 2 | Receptor PK | cho1c.pk003.p17:fis | *Arabidopsis* | 3063445 | 14.0 |
| 4 | Receptor PK | ceb3.pk0012.a7 | *Arabidopsis* | 7488207 | 74.2 |
| 6 | MEK3 | cho1c.pk003.n23 | Tobacco | 1362112 | 16.5 |
| 8 | MEK3 | p0125.czaab60rb:fis | Tobacco | 1362112 | 180.0 |
| 10 | MEK3 | rlr24.pk0032.e10 | *Arabidopsis* | 7487975 | 13.5 |
| 12 | MEK3 | r10n.pk096.h23 | *Arabidopsis* | 7487976 | 30.5 |
| 14 | MEK3 | src3c.pk018.d10:fis | *Arabidopsis* | 4006878 | 92.5 |
| 16 | MEK3 | sr3c.pk011.g22 | *Arabidopsis* | 4006878 | 23.7 |
| 18 | Hap2a | ncs.pk0013.c4 | No hits | | — |
| 20 | Hap2c | etr1c.pk006.f9 | No hits | | — |
| 22 | Hap2a | vmb1na.pk015.d18 | *Arabidopsis* | 11282597 | 8.1 |
| 24 | Hap2a | vpl1c.pk008.o5:fis | Grape | 7141243 | 91.2 |
| 26 | Hap2c | vdb1c.pk001.m5:fis | Rice | 7489565 | 38.0 |
| 28 | Hap2c | cho1c.pk004.b19:fis | Rice | 7489565 | 94.3 |
| 30 | Hap2c | p0015.cdpgu90r:fis | Rice | 7489565 | 96.2 |
| 32 | Hap2a | cta1n.pk0070.f3:fis | Rice | 7489565 | 38.1 |
| 34 | Hap2a | cco1n.pk0014.d4:fis | *Arabidopsis* | 6634774 | 37.2 |
| 36 | Hap2a | cco1n.pk086.d20:fis | *Arabidopsis* | 6634774 | 36.3 |
| 38 | Hap2b | p0126.cnlau71r:fis | Rice | 7489565 | 23.7 |
| 40 | Hap2b | p0104.cabav52r | Rice | 7489565 | 16.7 |
| 42 | Hap2b | cho1c.pk007.l21:fis contig of: cca.pk0026.d6 | Rice | 7489565 | 35.0 |
| 44 | Hap2c | cen3n.pk0061.e10:fis cen3n.pk0135.c2 cho1c.pk001.n24 p0092.chwae40r | Rice | 7489565 | 43.5 |
| 46 | Hap2c | cpf1c.pk006.e3:fis contig of: | Rice Rice | 7489565 7489565 | 44.0 |
| 48 | Hap2c | cr1n.pk0080.g6 p0003.cgpge51r | | | 35.0 |
| 50 | Hap2c | p0015.cdpfm55r:fis | *Arabidopsis* | 4587559 | 26.4 |
| 52 | Hap2 | p0083.cldct11r:fis | Rice | 7489565 | 91.4 |
| 54 | Hap2 | p0083.cldeu68r:fis | Rice | 7489565 | 14.2 |
| 56 | Hap2a | pps1c.pk001.h3:fis | *Arabidopsis* | 9293997 | 45.5 |
| 58 | Hap2c | pps1c.pk007.j21:fis | *Arabidopsis* | 5903072 | 53.7 |
| 60 | Hap2 | rr1.pk0030.f7:fis | Rice | 7489565 | identical |
| 62 | Hap2a | rls72.pk0023.c8:fis | *Arabidopsis* | 9293997 | 36.5 |
| 64 | Hap2a | rca1n.pk002.c15 | Grape | 7141243 | 7.7 |
| 66 | Hap2a | rds3c.pk001.g9 | Rice | 7489565 | 18.2 |
| 68 | Hap2b | rca1n.pk002.j3:fis | Rice | 7489565 | 26.0 |
| 70 | Hap2c | rca1n.pk029.n22:fis | *Arabidopsis* | 8778470 | 29.2 |
| 72 | Hap2b | r10n.pk131.j17 | Rice | 7489565 | 10.5 |
| 74 | Hap2a | sdp3c.pk018.b9:fis | *Arabidopsis* | 2398521 | 74.5 |
| 76 | Hap2a | sfl1.pk0102.h8 | Grape | 7141243 | 36.7 |
| 78 | Hap2a | srr3c.pk001.l10:fis | *Brassica* | 1586551 | 48.7 |
| 80 | Hap2a | sdp2c.pk003.o5:fis | *Arabidopsis* | 6634774 | 53.0 |
| 82 | Hap2b | sif1c.pk001.m16:fis | *Arabidopsis* | 6714441 | 180.0 |
| 84 | Hap2c | src1c.pk003.o16:fis | Rice | 7489565 | 33.5 |
| 86 | Hap2c | src3c.pk012.m6:fis | Rice | 7489565 | 31.5 |
| 88 | Hap2a | hss1c.pk011.h10:fis | *Arabidopsis* | 9293997 | 48.7 |
| 90 | Hap2c | wr1.pk0094.f2:fis | Rice | 7489565 | 92.7 |
| 92 | Hap2a | wre1n.pk0143.h2:fis | *Arabidopsis* | 6634774 | 35.0 |
| 94 | Hap2b | wds1f.pk002.p21:fis contig of: | *Arabidopsis* Rice | 6714441 7489565 | 26.5 |
| 96 | Hap2b | wdi1c.pk002.b10 wr1.pk0153.c7:fis | | | 38.5 |
| 98 | Hap2c | wre1n.pk0066.e4:fis | Rice | 7489565 | 42.7 |
| 100 | Hap5c | ect1c.pk001.k17:fis | Rice | 5257260 | 57.0 |
| 102 | Hap5a | vrr1c.pk004.o20:fis | *Arabidopsis* | 6523090 | 93.0 |
| 104 | Hap5a | clm1f.pk001.k17:fis | *Arabidopsis* | 6523090 | 66.7 |
| 106 | Hap5b | cde1n.pk003.a5:fis | *Arabidopsis* | 3776575 | 57.0 |
| 108 | Hap5b | cen3n.pk0164.a10:fis | *Arabidopsis* | 3776575 | 57.0 |

TABLE 3-continued

BLAST Results for Sequences Encoding Polypeptides Homologous
to Proteins Involved in Altering Oil Phenotypes

| SEQ ID NO. | Gene Name | Clone | Homolog | Genbank # | pLOG |
|---|---|---|---|---|---|
| 110 | Hap5b | p0118.chsbc77r | Arabidopsis | 3776575 | 58.5 |
| 112 | Hap5c | cco1n.pk055.o18 | Rice | 5257260 | 41.0 |
| 114 | Hap5c | cho1c.pk001.l23:fis | Rice | 5257260 | 82.0 |
| 116 | Hap5c | cse1c.pk001.h6:fis | Rice | 5257260 | 86.4 |
| 118 | Hap5a | rlm3n.pk005.d20:fis | Arabidopsis | 6523090 | 66.7 |
| 120 | Hap5b | rr1.pk0003.a3:fis | Arabidopsis | 6289057 | 58.5 |
| 122 | Hap5b | rr1.pk0039.d4:fis | Arabidopsis | 3776575 | 57.2 |
| 124 | Hap5c | rca1n.pk02l.b20:fis | Rice | 5257260 | 74.0 |
| 126 | Hap5a | sdp2c.pk029.k17:fis | Arabidopsis | 6523090 | 90.5 |
| 128 | Hap5a | sdp2c.pk044.e5:fis | Arabidopsis | 6523090 | 92.4 |
| 130 | Hap5b | sgs4c.pk004.j2 | Arabidopsis | 3776575 | 18.5 |
| 132 | Hap5b | src3c.pk002.h4:fis | Arabidopsis | 6289057 | 61.1 |
| 134 | Hap5b | src3c.pk009.b15:fis | Arabidopsis | 6289057 | 61.5 |
| 136 | Hap5b | src3c.pk019.d4:fis | Arabidopsis | 6056368 | 51.5 |
| 138 | Hap5c | sls1c.pk032.j4:fis | Arabidopsis | 6289057 | 74.5 |
| 140 | Hap5 | wdk2c.pk009.e4:fis | Rice | 5257260 | 20.0 |
| 142 | Hap5a | Contig of: wlm96.pk036.j11 wlm96.pk060.d5:fis | Arabidopsis | 9758288 | 19.7 |
| 144 | Hap5c | wle1n.pk0076.h7:fis | Rice | 5257260 | 82.0 |
| 146 | LIP 15 | cco1n.pk068.f18:fis | Corn | 2130123 | 69.4 |
| 148 | LIP 15 | cco1n.pk089.g17 | Corn | 2130123 | 54.0 |
| 150 | LIP 15 | rls6.pk0066.c9:fis | Rice | 479696 | 77.3 |
| 152 | LIP 15 | sdp4c.pk009.e3:fis | Arabidopsis | 7340713 | 36.1 |
| 154 | LIP 15 | sdp3c.pk019.n1:fis | pepper | 4457221 | 45.7 |
| 156 | LIP 15 | wl1n.pk0114.f9:fis | Corn | 2130123 | 69.1 |
| 158 | Ca2+ EF HP | ccase-b.pk0003.b9:fis | Sesame | 6478218 | 82.7 |
| 160 | Ca2+ EF HP | ceb5.pk0081.b4 | Sesame | 6478218 | 91.0 |
| 162 | Ca2+ EF HP | cbn10.pk0064.e6 | Sesame | 6478218 | 35.4 |
| 164 | Ca2+ EF HP | cm11c.pk001.e2 | Sesame | 6478218 | 30.3 |
| 166 | Ca2+ EF HP | cpd1c.pk008.e21 | Sesame | 6478218 | 64.2 |
| 168 | Ca2+ EF HP | cta1n.pk0074.h11 | Sesame | 6478218 | 24.1 |
| 170 | Ca2+ EF HP | p0031.ccmbc81r | Sesame | 6478218 | 26.4 |
| 172 | Ca2+ EF HP | p0134.carah47r | Sesame | 6478218 | 34.2 |
| 174 | Ca2+ EF HP | rca1n.pk021.l20 | Sesame | 6478218 | 50.2 |
| 176 | Ca2+ EF HP | rca1n.pk004.j14:fis | Rice | 7459612 | 69.0 |
| 178 | Ca2+ EF HP | rca1n.pk026.m9 | Sesame | 6478218 | 29.7 |
| 180 | Ca2+ EF HP | rsl1n.pk013.g2 | Sesame | 6478218 | 27.7 |
| 182 | Ca2+ EF HP | sfl1.pk131.j19 | Sesame | 6478218 | 29.2 |
| 184 | Ca2+ EF HP | sfl1.pk135.g3 | Sesame | 6478218 | 29.5 |
| 186 | Ca2+ EF HP | sgc5c.pk001.h16 | Sesame | 6478218 | 25.5 |
| 188 | Ca2+ EF HP | sls1c.pk020.h24 | Sesame | 6478218 | 16.5 |
| 190 | Ca2+ EF HP | sr1.pk0041.a11:fis | Sesame | 6478218 | 47.0 |
| 192 | Ca2+ EF HP | sr1.pk0049.c2 | Sesame | 6478218 | 17.4 |
| 194 | Ca2+ EF HP | wdk5c.pk006.m13 | Sesame | 6478218 | 41.4 |
| 196 | Ca2+ EF HP | wdk9n.pk001.k5 | Sesame | 6478218 | 40.7 |
| 198 | Ca2+ EF HP | wdr1f.pk003.b21:fis | Arabidopsis | 2459421 | 65.0 |
| 200 | ATP Cit Ly1 | cdo1c.pk001.c1:fis | Arabidopsis | 3482918 | 180.0 |
| 202 | ATP Cit Ly2 | ctn1c.pk002.o4 | Arabidopsis | 9759429 | 180.0 |
| 204 | ATP Cit Ly2 | p0032.crcav77r:fis | Arabidopsis | 9759429 | 180.0 |
| 206 | ATP Cit Ly1 | p0037.crwbs90r:fis | Arabidopsis | 3482918 | 180.0 |
| 208 | ATP Cit Ly1 | r10n.pk0015.a4:fis | Arabidopsis | 3482918 | 180.0 |
| 210 | ATP Cit Ly1 | rlr2.pk0012.d2 | Arabidopsis | 3482918 | 23.5 |
| 212 | ATP Cit Ly1 | rr1.pk097.f22:fis | Arabidopsis | 3482918 | 180.0 |
| 214 | ATP Cit Ly2 | rls6.pk0033.a9:fis | Arabidopsis | 9759429 | 180.0 |
| 216 | ATP Cit Ly2 | sdp2c.pk023.n6:fis | Arabidopsis | 9759429 | 180.0 |
| 218 | ATP Cit Ly1 | sfl1.pk0029.h10:fis | Arabidopsis | 2462746 | 180.0 |
| 220 | ATP Cit Ly2 | sic1c.pk003.o13:fis | Arabidopsis | 9759429 | 180.0 |
| 222 | ATP Cit Ly1 | sls1c.pk010.l1:fis | Arabidopsis | 3482918 | 180.0 |
| 224 | ATP Cit Ly2 | sls2c.pk007.c23:fis | Sordaria | 4107343 | 180.0 |
| 226 | ATP Cit Ly1 | src2c.pk009.g9:fis | Arabidopsis | 2462746 | 180.0 |
| 228 | ATP Cit Ly2 | wde1f.pk003.h2:fis | Arabidopsis | 9759429 | 180.0 |
| 230 | ATP Cit Ly1 | wia1c.pk001.d20:fis | Arabidopsis | 3482918 | 180.0 |
| 232 | ATP Cit Ly2 | wlm96.pk035.j11:fis | Sordaria | 4107343 | 180.0 |
| 234 | SNF1 | cen3n.pk0044.b8:fis | Arabidopsis | 5051782 | 180.0 |
| 236 | SNF1 | p0016.ctsbf56rb | Oryza sativa | 4107001 | 180.0 |
| 238 | SNF1 | p0118.chsbh89r Contig of: cen3n.pk0123.g6 cho1lc.pk021.k16 | Oryza sativa | 4107009 | 180.0 |

TABLE 3-continued

BLAST Results for Sequences Encoding Polypeptides Homologous to Proteins Involved in Altering Oil Phenotypes

| SEQ ID NO. | Gene Name | Clone | Homolog | Genbank # | pLOG |
|---|---|---|---|---|---|
| 240 | SNF1 | cmm.pk007.c3.f | Oryza sativa | 4107009 | 180.0 |
| | | p0019.clwab75rb | | | |
| | | p0119.cmtmj75r | | | |
| | | p0123.cammb73r | | | |
| | | p0126.cnlds35r | | | |
| | | Contig of: | | | |
| 242 | SNF1 | rda.pk007.g3 | Arabidopsis | 4895200 | 58.3 |
| | | rr1.pk0008.e12 | | | |
| | | rr1.pk0047.g12 | | | |
| 244 | SNF1 | rr1.pk0047.g12:fis | Arabidopsis | 7630013 | 143.0 |
| 246 | SNF1 | sdp4c.pk016.e10 | Arabidopsis | 2980770 | 180.0 |
| 248 | SNF1 | sdr1f.pk001.p7 | Cucumis | 1743009 | 180.0 |
| 250 | SNF1 | sgs4c.pk006.g6 | Arabidopsis | 2980770 | 180.0 |
| 252 | SNF1 | sgs4c.pk006.n21 | Glycine max | 4567091 | 180.0 |
| 254 | SNF1 | srr1c.pk001.i24:fis | Arabidopsis | 3885328 | 180.0 |
| 256 | SNF1 | wdk2c.pk018.c16:fis | Oryza sativa | 4107001 | 180.0 |
| 258 | SNF1 | wlm96.pk0007.e4:fis | Oryza sativa | 4107009 | 180.0 |
| 260 | Lec1 | eas1c.pk003.e16 | Arabidopsis | 9758795 | 49.2 |
| 262 | Lec1 | fds1n.pk008.m14 | Arabidopsis | 9758795 | 46.1 |
| 264 | Lec1 | p0015.cdpg75rb:fis | Arabidopsis | 9758795 | 45.4 |
| 266 | Lec1 | p0083.clder12r:fis | Arabidopsis | 6552738 | 35.2 |
| 268 | Lec1 | pps1c.pk002.l19 | Arabidopsis | 9758795 | 45.2 |
| | | Contig of: | | | |
| 270 | Lec1 | scb1c.pk004.j10 | Arabidopsis | 9758795 | 47.4 |
| | | se1.pk0042.d8:fis | | | |
| 272 | Lec1 | se2.11d12:fis | Arabidopsis | 9758795 | 52.2 |
| 274 | Lec1 | ses2w.pk0015.a4:fis | Arabidopsis | 9758795 | 43.7 |
| 276 | Lec1 | vs1n.pk013.m13:fis | Arabidopsis | 9758795 | 53.1 |
| 278 | Lec1 | wdk3c.pk023.h15:fis | Arabidopsis | 9758795 | 36.7 |
| 280 | Lec1-CCAAT | ect1c.pk007.p18:fis | Zea mays | 22380 | 44.7 |
| 282 | Lec1-CCAAT | fds.pk0003.h5:fis | Arabidopsis | 6729485 | 57.7 |
| 284 | Lec1-CCAAT | eef1c.pk004.c8:fis | Zea mays | 22380 | 61.7 |
| 286 | Lec1-CCAAT | cbn10.pk0005.e6:fis | Zea mays | 22380 | 72.2 |
| 288 | Lec1-CCAAT | p0006.cbysa51r:fis | Arabidopsis | 2244810 | 55.5 |
| 290 | Lec1-CCAAT | rl0n.pk0061.c8:fis | Zea mays | 22380 | 46.5 |
| 292 | Lec1-CCAAT | rsl1n.pk002.g10:fis | Zea mays | 22380 | 68.7 |
| 294 | Lec1-CCAAT | ses4d.pk0037.e3:fis | Arabidopsis | 2398529 | 49.0 |
| 296 | Lec1-CCAAT | src2c.pk003.i13:fis | Arabidopsis | 3738293 | 41.1 |
| 298 | Lec1-GCAAT | src2c.pk011.m12:fis | Arabidopsis | 6729485 | 62.0 |
| 300 | Lec1-CCAAT | src2c.pk025.b3:fis | Zea mays | 22380 | 45.5 |
| 302 | Lec1-CCAAT | src3c.pk028.j21:fis | Zea mays | 22380 | 54.3 |
| 304 | Lec1-CCAAT | wkm1c.pk0002.d7:fis | Zea mays | 22380 | 79.5 |
| 306 | Lec1-CCAAT | wlk8.pk0001.e10:fis | Arabidopsis | 2398529 | 52.7 |
| 308 | Lec1-CCAAT | wlm96.pk037.k9:fis | Zea mays | 22380 | 73.5 |
| 310 | CKC 6 | fds1n.pk015.l15 | Arabidopsis | 2887500 | 28.3 |
| | | contig of: | | | |
| 312 | CKC 2 | ece1c.pk003.g23 | Arabidopsis | 11357162 | 77.4 |
| | | ece1c.pk005.j13 | | | |
| 314 | CKC 8 | ids.pk0022.b6 | Zea mays | 7489754 | 40.0 |
| | | contig of: | | | |
| 316 | CKC 1 | cpd1c.pk011.i5 | Arabidopsis | 2129537 | 56.2 |
| | | p0086.cbsaa24r:fis | | | |
| 318 | CKC 1 | cpd1c.pk011.i5:fis | Arabidopsis | 2129537 | |
| 320 | CKC 2 | cde1c.pk003.o22:fis | Arabidopsis | 6587812 | 73.1 |
| 322 | CKC 2 | cho1c.pk003.f17:fis | Arabidopsis | 1171429 | 61.2 |
| | | contig of: | | | |
| 324 | CKC 5 | cds1f.pk003.b12 | Arabidopsis | 6587812 | 75.2 |
| | | clm1f.pk002.o13:fis | | | |
| 326 | CKC 2 | p0015.cdpfn03r | No hit | — | — |
| | | contig of: | | | |
| 328 | CKC 3 | cc71se-a.pk0002.e11 | Arabidopsis | 6648171 | 66.2 |
| | | p0027.cgsag51r:fis | | | |
| 330 | CKC 6 | p0031.ccmau15r:fis | Arabidopsis | 2887500 | 99.0 |
| 332 | CKC 8 | cc71se-b.pk0018.e4:fis | Zea mays | 7489754 | 180.0 |
| 334 | CKC 7 | cpj1c.pk005.m20:fis | Zea mays | 2652938 | 180.0 |
| 336 | CKC 8 | cen7f.pk002.m15 | Zea mays | 7489754 | 34.0 |
| 338 | CKC 8 | rsl1n.pk006.n24:fis | Zea mays | 7489754 | 180.0 |
| | | Contig of: | | | |
| 340 | CKC 8 | rca1n.pk019.p10 | Arabidopsis | 6648171 | 62.1 |
| | | rsl1n.pk002.j2:fis | | | |
| 342 | CKC 1 | rdi2c.pk009.a15 | Arabidopsis | 2129537 | 87.7 |
| 344 | CKC 2 | sds1f.pk001.f7:fis | Arabidopsis | 6587812 | 108.0 |

TABLE 3-continued

BLAST Results for Sequences Encoding Polypeptides Homologous to Proteins Involved in Altering Oil Phenotypes

| SEQ ID NO. | Gene Name | Clone | Homolog | Genbank # | pLOG |
|---|---|---|---|---|---|
| 346 | CKC 2 | se3.pk0034.a3 | Arabidopsis | 7715603 | 30.0 |
| 348 | CKC 6 | ses2w.pk0035.a9:fis | Arabidopsis | 2652938 | 162.0 |
| 350 | CKC 4 | ses4d.pk0043.d10:fis | Arabidopsis | 4836931 | 58.0 |
| 352 | CKC 5 | scb1c.pk004.n19:fis | Arabidopsis | 4836931 | 109.0 |
| 354 | CKC 5 | ses4d.pk0006.a12:fis | Arabidopsis | 4836931 | 109.0 |
| 356 | CKC 5 | sgs1c.pk004.f19:fis | | | |
| 358 | CKC 8 | sic1c.pk003.o18:fis | Zea mays | 2652938 | 107.0 |
| 360 | CKC 8 | sde4c.pk0001.a2:fis | Arabidopsis | 1171429 | 98.0 |
| 362 | CKC 3 | ses2w.pk0012.d10:fis | Arabidopsis | 9294411 | 177.0 |
| 364 | CKC 1 | Contig of: wde1f.pk001.h1 wr1.pk148.f7:fis | Arabidopsis | 6648171 | 54.7 |
| 459 | Lec1 | rice genome seq | Oryza sativa | 7378310 | 180 |
| 461 | Hap2 | ncs.pk0013.c4:fis | Arabidopsis | 9293997 | 46.7 |
| 463 | Hap2 | p0117.chcln94r:fis | Oryza sativa | 1489565 | 26.0 |
| 465 | Hap2 | rdi2c.pk011.f19:fis | Oryza sativa | 1489565 | 45.0 |
| 467 | Hap2 | sfl1.pk0101.g7:fis | Vitis sp. | 7141243 | 38.4 |
| 469 | Hap2 | wdi1c.pk002.b10:fis | Oryza sativa | 1489565 | 40.3 |
| 474 | Hap5 | sgs4c.pk004.j2:fis | Arabidopsis | 15223482 | 69.0 |
| 477 | CKC 2 | fds1n.pk015.l15:fis | Arabidopsis | 18394319 | 77.3 |
| 479 | CKC 2 | ece1c.pk003.g23:fis | Arabidopsis | 18394319 | 77.3 |
| 481 | CKC 2 | se3.pk0034.a3:fis | Arabidopsis | 18394319 | 77.3 |
| 483 | CKC 4 | sre.pk0037.c1:fis | Arabidopsis | 15238174 | 157.0 |
| 485 | CKC 7 | ncs.pk0013.a9:fis | Oryza sativa | 20161013 | 96.7 |
| 487 | CKC 8 | egh1c.pk005.k20 | Oryza sativa | 20161013 | 98.5 |
| 489 | CKC 8 | cde1c.pk003.n23:fis | Zea mays | 7489754 | 110.0 |
| 491 | CKC 1 | sde4c.pk0001.a2:fis | Arabidopsis | 1171429 | 98.0 |
| 493 | MEK3 | sr3.pk011.g22:fis | Arabidopsis | 4006878 | 91.3 |
| 495 | MEK3 | r10n.pk096.h23:fis | Arabidopsis | 7487975 | 63.4 |
| 497 | MEK3 | rlr24.pk0032.e10:fis | Arabidopsis | 7487975 | 63.5 |
| 499 | Ca2+ EF HP | cml1c.pk001.e2:fis | Sesame | 6478218 | 41.5 |
| 501 | Ca2+ EF HP | cdp1c.pk008.e21:fis | Sesame | 6478218 | 65.0 |
| 503 | Ca2+ EF HP | cta1n.pk0074.h11:fis | Sesame | 6478218 | 37.0 |
| 505 | Ca2+ EF HP | p0031.ccmbc81r:fis | Sesame | 6478218 | 65.7 |
| 507 | Ca2+ EF HP | p0134.carah47r:fis | Sesame | 6478218 | 34.7 |
| 509 | Ca2+ EF HP | rca1n.pk004.j14:fis | Oryza sativa | 1177320 | 69.0 |
| 511 | Ca2+ EF HP | rsl1n.pk013.g2:fis | Sesame | 6478218 | 41.5 |
| 513 | Ca2+ EF HP | sfl1.pk131.j19:fis | Sesame | 6478218 | 47.7 |
| 515 | Ca2+ EF HP | sfl1.pk135.g3:fis | Sesame | 6478218 | 47.7 |
| 517 | Ca2+ EF HP | sls1c.pk020.h24:fis | Sesame | 6478218 | 47.4 |
| 519 | Ca2+ EF HP | sr1.pk0041.a11:fis | Sesame | 6478218 | 47.0 |
| 521 | Ca2+ EF HP | sr1.pk0049.c2:fis | Sesame | 6478218 | 48.0 |
| 523 | Ca2+ EF HP | wdk5c.pk006.m13:fis | Sesame | 6478218 | 80.0 |
| 525 | Ca2+ EF HP | wdk9n.pk001.k5:fis | Sesame | 6478218 | 83.0 |
| 527 | Ca2+ EF HP | wdk1f.pk003.b21:fis | Arabidopsis | 2459421 | 65.0 |

The sequence of the entire cDNA insert in the clones listed in Table 3 was determined. Further sequencing and searching of the DuPont proprietary database allowed the identification of other corn, rice, soybean and/or wheat clones encoding polypeptides involved in altering oil phenotypes. The BLASTX search using the sequences from clones listed in Table 4 revealed similarity of the polypeptides encoded by the various cDNAs from plant and fungal species (noted by their NCBI General Identifier No. in Tables 3 and 4). Shown in Table 4 are the BLAST results for individual ESTs ("EST"), the sequences of the entire cDNA inserts comprising the indicated cDNA clones ("FIS"), sequences of contigs assembled from two or more ESTs ("Contig"), sequences of contigs assembled from an FIS and one or more ESTs ("Contig*"), or sequences encoding the entire protein derived from an FIS, a contig, or an FIS and PCR ("CGS"):

TABLE 4

Percent Identity of Amino Acid Sequences Deduced From the Nucleotide Sequences of cDNA Clones Encoding Polypeptides Homologous to Polypeptides Involved in Altering Plant Oil Phenotypes

| SEQ ID NO. | Accession No. | Percent Identity |
|---|---|---|
| 2 | 3063445 | 33.3% |
| 4 | 7488207 | 83.9% |
| 6 | 1362112 | 51.2% |
| 8 | 1362112 | 66.8% |
| 10 | 7487975 | 27.5% |
| 12 | 7487976 | 39.7% |
| 14 | 4006878 | 45.6% |
| 16 | 4006878 | 42.7% |
| 18 | 1586551 | 23.4% |
| 20 | 7489565 | 27.4% |
| 22 | 11282597 | 22.1% |

TABLE 4-continued

Percent Identity of Amino Acid Sequences Deduced
From the Nucleotide Sequences of cDNA Clones
Encoding Polypeptides Homologous to Polypeptides
Involved in Altering Plant Oil Phenotypes

| SEQ ID NO. | Accession No. | Percent Identity |
|---|---|---|
| 26 | 7489565 | 36.1% |
| 28 | 7489565 | 67.2% |
| 30 | 7489565 | 70.6% |
| 32 | 7489565 | 33.2% |
| 34 | 6634774 | 40.1% |
| 36 | 6634774 | 39.1% |
| 38 | 7489565 | 28.2% |
| 40 | 7489565 | 53.2% |
| 42 | 7489565 | 34.0% |
| 44 | 7489565 | 39.5% |
| 46 | 7489565 | 39.5% |
| 48 | 7489565 | 35.5% |
| 50 | 4587559 | 54.1% |
| 52 | 7489565 | 67.2% |
| 54 | 7489565 | 29.0% |
| 56 | 9293997 | 31.5% |
| 58 | 5903072 | 35.3% |
| 62 | 5903072 | 33.7% |
| 64 | 7141243 | 34.5% |
| 66 | 7489565 | 35.7% |
| 68 | 7489565 | 27.2% |
| 70 | 8778470 | 40.5% |
| 72 | 7489565 | 22.1% |
| 74 | 2398521 | 49.1% |
| 76 | 7141243 | 40.9% |
| 78 | 1586551 | 37.8% |
| 80 | 6634774 | 49.2% |
| 82 | 6714441 | 32.5% |
| 84 | 7489565 | 32.4% |
| 86 | 7489565 | 31.1% |
| 88 | 9293997 | 40.6% |
| 90 | 7489565 | 68.5% |
| 92 | 6634774 | 36.5% |
| 94 | 6714441 | 23.7% |
| 96 | 7489565 | 34.5% |
| 98 | 7489565 | 37.4% |
| 100 | 5257260 | 62.9% |
| 102 | 6523090 | 77.7% |
| 104 | 6523090 | 53.8% |
| 106 | 3776575 | 50.7% |
| 108 | 3776575 | 51.6% |
| 110 | 3776575 | 60.0% |
| 112 | 5257260 | 62.7% |
| 114 | 5257260 | 75.0% |
| 116 | 5257260 | 77.5% |
| 118 | 6523090 | 53.8% |
| 120 | 6289057 | 50.6% |
| 122 | 3776575 | 52.1% |
| 124 | 5257260 | 77.9% |
| 126 | 6523090 | 70.3% |
| 128 | 6523090 | 70.7% |
| 130 | 3776575 | 35.7% |
| 132 | 6289057 | 53.2% |
| 134 | 6289057 | 52.8% |
| 136 | 6056368 | 73.0% |
| 138 | 6289057 | 57.1% |
| 140 | 5257260 | 27.3% |
| 142 | 9758288 | 46.3% |
| 144 | 5257260 | 74.9% |
| 148 | 2130123 | 83.0% |
| 152 | 7340713 | 50.7% |
| 154 | 4457221 | 56.9% |
| 158 | 6478218 | 57.0% |
| 160 | 6478218 | 61.9% |
| 162 | 6478218 | 33.6% |
| 164 | 6478218 | 41.3% |
| 166 | 6478218 | 46.9% |
| 168 | 6478218 | 46.6% |
| 170 | 6478218 | 48.4% |
| 172 | 6478218 | 31.8% |
| 174 | 6478218 | 64.4% |
| 176 | 7459612 | 49.8% |
| 178 | 6478218 | 62.1% |
| 180 | 6478218 | 36.7% |
| 182 | 6478218 | 46.5% |
| 184 | 6478218 | 45.3% |
| 186 | 6478218 | 53.8% |
| 188 | 6478218 | 47.5% |
| 190 | 6478218 | 41.3% |
| 192 | 6478218 | 52.5% |
| 194 | 6478218 | 57.2% |
| 196 | 6478218 | 58.4% |
| 198 | 2459421 | 42.4% |
| 200 | 3482918 | 85.4% |
| 202 | 9759429 | 92.1% |
| 204 | 9759429 | 92.3% |
| 206 | 3482918 | 87.4% |
| 208 | 3482918 | 87.0% |
| 210 | 3482918 | 63.3% |
| 212 | 3482918 | 87.5% |
| 214 | 9759429 | 92.8% |
| 216 | 9759429 | 89.6% |
| 218 | 2462746 | 84.4% |
| 220 | 9759429 | 93.3% |
| 222 | 3482918 | 87.5% |
| 224 | 4107343 | 89.8% |
| 226 | 2462746 | 88.9% |
| 228 | 9759429 | 91.8% |
| 230 | 3482918 | 87.9% |
| 232 | 4107343 | 90.1% |
| 244 | 7630013 | 63.0% |
| 256 | 4107001 | 89.2% |
| 258 | 4107009 | 81.2% |
| 260 | 9758795 | 49.0% |
| 262 | 9758795 | 49.7% |
| 264 | 9758795 | 49.8% |
| 266 | 6552738 | 38.9% |
| 310 | 2887500 | 45.3% |
| 312 | 11357162 | 68.8% |
| 316 | 2129537 | 37.2% |
| 318 | 2129537 | 37.2% |
| 320 | 6587812 | 43.1% |
| 328 | 6648171 | 36.2% |
| 330 | 2887500 | 41.6% |
| 332 | 7489754 | 87.0% |
| 338 | 7489754 | 66.1% |
| 342 | 2129537 | 83.1% |
| 344 | 6587812 | 60.9% |
| 348 | 2652938 | 41.6% |
| 352 | 4836931 | 40.5% |
| 354 | 4836931 | 39.3% |
| 358 | 2652938 | 42.3% |
| 362 | 9294411 | 49.8% |
| 477 | 18394319 | 44.1% |
| 479 | 18394319 | 44.3% |
| 481 | 18394319 | 42.3% |
| 483 | 15238174 | 50.4% |
| 485 | 20161013 | 42.1% |
| 487 | 20161013 | 40.7% |
| 489 | 7489754 | 44.1% |
| 491 | 1171429 | 36.4% |
| 493 | 4006878 | 46.3% |
| 495 | 7487975 | 31.2% |
| 497 | 7487975 | 30.0% |
| 499 | 6478218 | 37.5% |
| 501 | 6478218 | 48.5% |
| 503 | 6478218 | 44.3% |
| 505 | 6478218 | 48.4% |
| 507 | 6478218 | 35.0% |
| 509 | 1177320 | 54.2% |
| 511 | 6478218 | 40.0% |
| 513 | 6478218 | 46.5% |
| 515 | 6478218 | 47.5% |
| 517 | 6478218 | 47.5% |

TABLE 4-continued

Percent Identity of Amino Acid Sequences Deduced
From the Nucleotide Sequences of cDNA Clones
Encoding Polypeptides Homologous to Polypeptides
Involved in Altering Plant Oil Phenotypes

| SEQ ID NO. | Accession No. | Percent Identity |
|---|---|---|
| 519 | 6478218 | 45.8% |
| 521 | 6478218 | 47.0% |
| 523 | 6478218 | 57.2% |
| 525 | 6478218 | 58.6% |
| 527 | 2459421 | 49.1% |

Sequence alignments and percent identity calculations were performed using the Megalign program of the LASERGENE bioinformatics computing suite (DNASTAR Inc., Madison, Wis.). Multiple alignment of the sequences was performed using the Clustal method of alignment (Higgins and Sharp (1989) CABIOS. 5:151–153) with the default parameters (GAP PENALTY=10, GAP LENGTH PENALTY=10). Default parameters for pairwise alignments using the Clustal method were KTUPLE 1, GAP PENALTY=3, WINDOW=5 and DIAGONALS SAVED=5. Sequence alignments and BLAST scores and probabilities indicate that the nucleic acid fragments comprising the instant cDNA clones encode a substantial portion of cDNAs to receptor protein kinases, MEK3 homologs, Hap2 homologs, LIP 15 homologs, calcium EF-hand proteins, ATP citrate lyase, glucose metabolism proteins such as SNF1 homologs, Lec1 transcription factors, and seed developmentally regulated transcription factors such as CKC (Aintegumenta-like) homologs.

Example 4

Expression of Chimeric Constructs in Monocot Cells

A chimeric construct comprising a cDNA encoding the instant polypeptides in sense orientation with respect to the maize 27 kD zein promoter that is located 5' to the cDNA fragment, and the 10 kD zein 3' end that is located 3' to the cDNA fragment, can be constructed. The cDNA fragment of this gene may be generated by polymerase chain reaction (PCR) of the cDNA clone using appropriate oligonucleotide primers. Cloning sites (NcoI or SmaI) can be incorporated into the oligonucleotides to provide proper orientation of the DNA fragment when inserted into the digested vector pML103 as described below. Amplification is then performed in a standard PCR. The amplified DNA is then digested with restriction enzymes NcoI and SmaI and fractionated on an agarose gel. The appropriate band can be isolated from the gel and combined with a 4.9 kb NcoI-SmaI fragment of the plasmid pML103. Plasmid pML103 has been deposited under the terms of the Budapest Treaty at ATCC (American Type Culture Collection, 10801 University Blvd., Manassas, Va. 20110-2209), and bears accession number ATCC 97366. The DNA segment from pML1 03 contains a 1.05 kb SalI-NcoI promoter fragment of the maize 27 kD zein gene and a 0.96 kb SmaI-SalI fragment from the 3' end of the maize 10 kD zein gene in the vector pGem9Zf (+) (Promega). Vector and insert DNA can be ligated at 15°0 C. overnight, essentially as described (Maniatis). The ligated DNA may then be used to transform E. coli XL1-Blue (Epicurian Coli XL-1 Blue™; Stratagene). Bacterial transformants can be screened by restriction enzyme digestion of plasmid DNA and limited nucleotide sequence analysis using the dideoxy chain termination method (Sequenase™ DNA Sequencing Kit; U.S. Biochemical). The resulting plasmid construct would comprise a chimeric gene encoding, in the 5' to 3' direction, the maize 27 kD zein promoter, a cDNA fragment encoding the instant polypeptides, and the 10 kD zein 3' region.

The chimeric construct described above can then be introduced into corn cells by the following procedure. Immature corn embryos can be dissected from developing caryopses derived from crosses of the inbred corn lines H99 and LH132. The embryos are isolated 10 to 11 days after pollination when they are 1.0 to 1.5 mm long. The embryos are then placed with the axis-side facing down and in contact with agarose-solidified N6 medium (Chu et al (1975) Sci. Sin. Peking 18:659–668). The embryos are kept in the dark at 27° C. Friable embryogenic callus consisting of undifferentiated masses of cells with somatic proembryoids and embryoids borne on suspensor structures proliferates from the scutellum of these immature embryos. The embryogenic callus isolated from the primary explant can be cultured on N6 medium and sub-cultured on this medium every 2 to 3 weeks.

The plasmid, p35S/Ac (obtained from Dr. Peter Eckes, Hoechst Ag, Frankfurt, Germany) may be used in transformation experiments in order to provide for a selectable marker. This plasmid contains the Pat gene (see European Patent Publication 0 242 236) which encodes phosphinothricin acetyl transferase (PAT). The enzyme PAT confers resistance to herbicidal glutamine synthetase inhibitors such as phosphinothricin. The pat gene in p35S/Ac is under the control of the 35S promoter from Cauliflower Mosaic Virus (Odell et al (1985) Nature 313:810–812) and the 3' region of the nopaline synthase gene from the T-DNA of the Ti plasmid of Agrobacterium tumefaciens.

The particle bombardment method (Klein et al (1987) Nature 327:70–73) may be used to transfer genes to the callus culture cells. According to this method, gold particles (1 μm in diameter) are coated with DNA using the following technique. Ten μg of plasmid DNAs are added to 50 μL of a suspension of gold particles (60 mg per ml). Calcium chloride (50 μL of a 2.5 M solution) and spermidine free base (20 μL of a 1.0 M solution) are added to the particles. The suspension is vortexed during the addition of these solutions. After 10 minutes, the tubes are briefly centrifuged (5 sec at 15,000 rpm) and the supernatant removed. The particles are resuspended in 200 μL of absolute ethanol, centrifuged again and the supernatant removed. The ethanol rinse is performed again and the particles resuspended in a final volume of 30 μL of ethanol. An aliquot (5 μL) of the DNA-coated gold particles can be placed in the center of a Kapton™ flying disc (Bio-Rad Labs). The particles are then accelerated into the corn tissue with a Biolistic™ PDS-1000/ He (Bio-Rad Instruments, Hercules Calif.), using a helium pressure of 1000 psi, a gap distance of 0.5 cm and a flying distance of 1.0 cm.

For bombardment, the embryogenic tissue is placed on filter paper over agarose-solidified N6 medium. The tissue is arranged as a thin lawn and covered a circular area of about 5 cm in diameter. The petri dish containing the tissue can be placed in the chamber of the PDS-1000/He approximately 8 cm from the stopping screen. The air in the chamber is then evacuated to a vacuum of 28 inches of Hg. The macrocarrier is accelerated with a helium shock wave using a rupture membrane that bursts when the He pressure in the shock tube reaches 1000 psi.

Seven days after bombardment the tissue can be transferred to N6 medium that contains bialophos (5 mg per liter) and lacks casein or proline. The tissue continues to grow slowly on this medium. After an additional 2 weeks the tissue can be transferred to fresh N6 medium containing bialophos. After 6 weeks, areas of about 1 cm in diameter of actively growing callus can be identified on some of the plates containing the bialophos-supplemented medium. These calli may continue to grow when sub-cultured on the selective medium.

Plants can be regenerated from the transgenic callus by first transferring clusters of tissue to N6 medium supplemented with 0.2 mg per liter of 2,4-D. After two weeks the tissue can be transferred to regeneration medium (Fromm et al (1990) *Bio/Technology* 8:833–839).

Example 5

Expression of Chimeric Constructs in Dicot Cells

A seed-specific expression cassette composed of the promoter and transcription terminator from the gene encoding the β subunit of the seed storage protein phaseolin from the bean *Phaseolus vulgaris* (Doyle et al (1986) *J. Biol. Chem.* 261:9228–9238) can be used for expression of the instant polypeptides in transformed soybean. The phaseolin cassette includes about 500 nucleotides upstream (5') from the translation initiation codon and about 1650 nucleotides downstream (3') from the translation stop codon of phaseolin. Between the 5' and 3' regions are the unique restriction endonuclease sites Nco I (which includes the ATG translation initiation codon), Sma I, Kpn I and Xba I. The entire cassette is flanked by Hind III sites.

The cDNA fragment of this gene may be generated by polymerase chain reaction (PCR) of the cDNA clone using appropriate oligonucleotide primers. Cloning sites can be incorporated into the oligonucleotides to provide proper orientation of the DNA fragment when inserted into the expression vector. Amplification is then performed as described above, and the isolated fragment is inserted into a pUC18 vector carrying the seed expression cassette.

Soybean embryos may then be transformed with the expression vector comprising sequences encoding the instant polypeptides. To induce somatic embryos, cotyledons, 3–5 mm in length dissected from surface sterilized, immature seeds of the soybean cultivar A2872, can be cultured in the light or dark at 26° C. on an appropriate agar medium for 6–10 weeks. Somatic embryos which produce secondary embryos are then excised and placed into a suitable liquid medium. After repeated selection for clusters of somatic embryos which multiplied as early, globular staged embryos, the suspensions are maintained as described below.

Soybean embryogenic suspension cultures can be maintained in 35 mL liquid media on a rotary shaker, 150 rpm, at 26° C. with florescent lights on a 16:8 hour day/night schedule. Cultures are subcultured every two weeks by inoculating approximately 35 mg of tissue into 35 mL of liquid medium.

Soybean embryogenic suspension cultures may then be transformed by the method of particle gun bombardment (Klein et al (1987) *Nature* (London) 327:70–73, U.S. Pat. No. 4,945,050). A DuPont Biolistic™ PDS1000/HE instrument (helium retrofit) can be used for these transformations.

A selectable marker gene which can be used to facilitate soybean transformation is a chimeric gene composed of the 35S promoter from Cauliflower Mosaic Virus (Odell et al (1985) *Nature* 313:810–812), the hygromycin phosphotransferase gene from plasmid pJR225 (from *E. coli*; Gritz et al(1983) *Gene* 25:179–188) and the 3' region of the nopaline synthase gene from the T-DNA of the Ti plasmid of *Agrobacterium tumefaciens*. The seed expression cassette comprising the phaseolin 5' region, the fragment encoding the instant polypeptides and the phaseolin 3' region can be isolated as a restriction fragment. This fragment can then be inserted into a unique restriction site of the vector carrying the marker gene.

To 50 µL of a 60 mg/mL 1 µm gold particle suspension is added (in order): 5 µL DNA (1 µg/µL), 20 µL spermidine (0.1 M), and 50 µL $CaCl_2$ (2.5 M). The particle preparation is then agitated for three minutes, spun in a microfuge for 10 seconds and the supernatant removed. The DNA-coated particles are then washed once in 400 µL 70% ethanol and resuspended in 40 µL of anhydrous ethanol. The DNA/particle suspension can be sonicated three times for one second each. Five µL of the DNA-coated gold particles are then loaded on each macro carrier disk.

Approximately 300–400 mg of a two-week-old suspension culture is placed in an empty 60×15 mm petri dish and the residual liquid removed from the tissue with a pipette. For each transformation experiment, approximately 5–10 plates of tissue are normally bombarded. Membrane rupture pressure is set at 1100 psi and the chamber is evacuated to a vacuum of 28 inches mercury. The tissue is placed approximately 3.5 inches away from the retaining screen and bombarded three times. Following bombardment, the tissue can be divided in half and placed back into liquid and cultured as described above.

Five to seven days post bombardment, the liquid media may be exchanged with fresh media, and eleven to twelve days post bombardment with fresh media containing 50 mg/mL hygromycin. This selective media can be refreshed weekly. Seven to eight weeks post bombardment, green, transformed tissue may be observed growing from untransformed, necrotic embryogenic clusters. Isolated green tissue is removed and inoculated into individual flasks to generate new, clonally propagated, transformed embryogenic suspension cultures. Each new line may be treated as an independent transformation event. These suspensions can then be subcultured and maintained as clusters of immature embryos or regenerated into whole plants by maturation and germination of individual somatic embryos.

Example 6

Gene Profiling of Corn Lines Displaying High Oil Phenotype

Plant Material

Seeds from the "maize lines" were germinated and grown in the field. Typical "maize lines" used are as follows:
1) Qx47, IHO, Ask c.28, Ryd c.7 (herein called "high oil lines");
2) GS3, HG11, B73, Ask c.0, Ryd c.0 (herein called "normal oil" or "control lines") and,
3) ILO (herein called "low oil line").

The ears of all plants were self-pollinated, and embryo tissues were collected at 10, 15, 20, 25, 30, 35, 40 and 45 DAP. All tissue was frozen immediately and stored at −80° C. until used. Total RNA was extracted followed by isolation of poly A+ RNA using standard molecular biology techniques (Sambrook et al (1989) "Molecular Cloning", Cold Spring Harbor Laboratory Press, CSH, NY).

The goal was to identify regulatory/structural genes that control oil content and/or germ size in corn. Two different transcript profiling techniques were used namely DNA microarray (Schena et al (1995) *Science* 270:368–9, 371), Lynx comparator (Brenner et al (2000) *Proc Natl Acad Sci U S A* 97:1665–70) and Lynx MPSS (Brenner et al (2000) *Nat Biotechnol* 18:630–4). These experiments were aimed at comparing transcription profiles between different high oil corn lines and their normal/low oil counterparts.

Molecular Dynamics Microarray Technology:

The steps of fluorescent mRNA probe labeling, amplification of target DNA, immobilization of target DNA on slide, hybridization to different developmental stage embryos of different corn lines, washings, signal detection, data acquisition and normalization of data were as described (Lee et al, 2001). The target DNA collection consisted of 900 corn EST's from DuPont Internal Database corresponding to genes expected to play a role in corn seed fatty acid, protein and carbohydrate metabolism and an additional 4000 random EST's from a corn embryo library also from DuPont Internal Database were selected. Gene profiling experiments were performed aimed at identifying genes differentially expressed in high oil germ lines when compared to lines with either normal or low levels of oil in the germ. Potential candidates were identified and selected if the relative gene expression of the gene in question showed a ratio of 2 or greater in at least one comparison involved at least one high oil line and either a low oil line or a line with normal levels of oil. Using this criteria to analyze these data we have identified two candidate regulatory genes whose expression is either altered when comparing the pattern of gene expression between the high oil lines and their normal/low oil counterparts (i.e. Ask cycle 28 to Ask cycle 0 ratio and/or IHO to ILO ratio): Caleosin (DuPont/Pioneer Internal Database EST ID# ccase-b.pk0003.b9, shown in SEQ ID NOs: 157–158) or, showed a similar expression pattern as several genes encoding enzymes of the oil biosynthesis pathway: Aintegumenta (DuPont/Pioneer Internal Database EST ID# adf1c.pk009.n6, which is identical to the *Arabidopsis thaliana* clone found in GenBank Accession No. gi 1171429, shown in SEQ ID NO: 424) and an additional corn clone, cho1c.pk003.f17:fis (SEQ ID NO: 322). We have also identified four other potential regulatory candidate genes, which in addition to show elevated gene expression when compared "internally" within the high oil population lines are also elevated when high oil lines were compared to the control line B73: receptor-like protein kinase (DuPont/Pioneer Internal Database EST ID# cho1c.pk003.p17, SEQ ID NOs:1–2), MAP kinase kinase 3 (DuPont/Pioneer Internal Database EST ID# p0125.czaab60rb, SEQ ID NOs:7–8), HAP2 (DuPont/Pioneer Internal Database EST ID# cho1c.pk006.b14 which is a shorter clone of cho1c.pk004.b19:fis, shown in SEQ ID NOs: 27–28), LIP15 (DuPont Internal Database EST ID# ceb3.pk0011.g9 which was replaced by clone ccoln.pk089.g17, shown in SEQ ID NOs: 147–148).

Lynx (Comparator and MPSS):

Gene profiling by Lynx was performed as described (Brenner et al (2000) *Proc Natl Acad Sci USA* 97:1665–70). Using this criteria to analyze these data we have identified two candidate regulatory genes whose expression is either altered when comparing the pattern of gene expression between the high oil lines and their normal/low oil counterparts (i.e. Ask cycle 28 to Ask cycle 0 ratio and/or IHO to ILO ratio): HAP5 (DuPont/Pioneer Internal Database EST ID# cho1c.pk001.123, SEQ ID NOs: 113–114) and SNF1/AMPK from corn (DuPont/Pioneer Internal Database EST ID# cen3n.pk0150.c7 which is a shorter clone of p0019.clwab:fis, one of the sequences used in the contig shown in SEQ ID NOs: 239–240).

Unlike the candidates listed above, other genes were chosen based on the knowledge of the role that the candidate gene they encode play in the partition of carbohydrate flux in the embryo: ATP-citrate lyase (DuPont Internal Database EST ID# cdo1c.pk001.c1, shown in SEQ ID NOs: 199–200), SNF1/AMPK from soybean (DuPont/Pioneer Internal Database EST ID# sdp4c.pk016.e10, shown in SEQ ID NOs: 245–246) or, regulation of gene expression in early embryo developmental phases: HAP3/Lec1 (DuPont/Pioneer Internal Database EST ID# p0015.cdpgp75rb, shown in SEQ ID NOs: 263–264).

Example 7

Expression Vector for Plant Transformation by Particle Gun Bombardment

A seed specific gene expression cassette was used for making chimeric constructs for expression of candidate genes in corn. The expression cassette is composed of the 0.9 kb oleosin promoter, the intron 1 of the maize shrunken 1 gene and adjacent exon (Vasil et al, 1989, *Plant Physiol* 91: 1575–1579; Mascarenhas et al, 1990, *Plant Mol Biol* 15:913–920) and 3' transcription termination region from the nopaline synthase (Nos) gene. In between the exon adjacent to the shrunken 1 gene and the nopaline synthase (Nos) gene are unique restriction endonuclease sites MfeI and XmaI. This vector has been designated pBN256 (REF. Jennie Shen's patent). pMUT256 refers to a pBN256 plasmid in which a EcoRI site has been removed by site directed mutagenesis. A modified version of pMUT256, designated pMUT256e was modified by addition of a synthetic multiple cloning site. The synthetic polylinker was generated by annealing of oligos (5'-acagtacagtacagtacagtacagt-3') and (5'-actgtactgtactgtacgtgactg-3') [SEQ ID NOs: 430 and 431, respectively] and subsequent subcloning into the pMut256 open with MfeI and XmaI. Additional expression cassettes/vectors will be described in reference to specific examples where they have been used (see below).

Example 8

Isolation and Cloning of Candidate Genes into Embryo-specific Plant Expression Vectors HAP3/LEC1 (Heme-Activated Protein 3/Leafy Cotyledon 1):

A full length clone (p001 5.cdpgp75rb, SEQ ID NOs: 263) for the corn homolog of the HAP3/Lec1 gene was obtained from Dupont/Pioneer EST Database. The ORF of maize HAP3/Lec1 (a 1 kb SalI/HpaI fragment, PCT Application No. WO 00/28058, published on May 18, 2000) was moved into an expression cassette containing a maize oleosin promoter (a 0.9 kb BamHI/XhoI fragment, PCT Application No. WO 99/64579, published on Dec. 16, 1999) and a polyadenylation sequence from the Agrobacterium nopaline synthase gene. This expression cassette was then subcloned adjacent to a 35S::Bar expression cassette (Sidorenko et al (2000) *Plant J* 22:471–482). The resulting expression cassettes flanked by T-DNA border sequences were then mobilized into the Agrobacterium "super-binary" vector (Komari, 1990) using electroporation. Additional constructs were made to confer expression patterns different from those obtained with the oleosin promoter. A ubiquitin promoter (UBI, Christensen et al (1992) *Plant Mol Biol* 18:675–680), a lipid transfer protein (LTP) promoter (U.S. Pat. No. 5,525,716), and a gamma zein promoter (GZP) (Boronat et al (1986) *Plant Science* 47: 95–102) were each fused to Lec1 as described above for the oleosin promoter. The two transcription units, LTP-Lec1 and GZP-Lec1, were combined into one expression construct next to the 35S:Bar expression construct and flanked by T-DNA border sequences (as described above).

HAP2 (Heme-Activated Protein 2):

A full length clone (cho1c.pk006.b14, a 30 nucleotide shorter cDNA than cho1c.pk004.b19:fis, shown in SEQ ID NO: 27) for the corn homolog of the HAP2 gene was obtained from Dupont/Pioneer EST Database. The ApoI/ApaI 1.1 kb fragment of cho1c.pk006.b14 was isolated and subcloned into pMUT256e opened by digestion with EcoRI/ApaI. One clone was selected for corn transformation by restriction digestion analysis for correct insert size. Subcloning artifacts were excluded by 5' and 3' sequence of the vector-insert boundaries.

HAP5 (Heme-Activated Protein 5):

A full length clone (cho1c.pk001.123, shown in SEQ ID NO: 113) for the corn homolog of HAP5 gene was obtained from Dupont/Pioneer EST Database. The EcoRI/ApaI 1.1 kb fragment of cho1c.pk001.123 was isolated and subcloned into pMUT256e opened by digestion with EcoRI/ApaI. One clone was selected for corn transformation after restriction digestion analysis for correct insert size. Subcloning artifacts were excluded by 5' and 3' sequence of the vector-insert boundaries.

Caleosin ($Ca^{2+}$ EF-hand Binding Protein):

A full length clone (ccase-b.pk0003.b9, shown in SEQ ID NO: 157)for a corn homolog of the Caleosin gene was obtained from Dupont/Pioneer EST Database. Two open reading frames were amplified from this sequence using PCR. One ORF contains nucleotides 253–987 and was amplified using primers (CTCMTTGCCCGGGMCATGCACCACGGCCTGTCG and CCCGGGCTAGGACATCTTGGCGTGCT [SEQ ID NOs: 432 and 433, respectively]), which introduce a MfeI restriction site just prior the translation start codon and a XmaI site just past the translation stop codon respectively.

The other ORF contains nucleotides 46–987 and was amplified using primers (AATTGATGCAGGGAGGGGCGACGGC and CCCGGGCTAGGACATCTTGGCGTGCT [SEQ ID NOs: 434 and 435, respectively]), which introduce a MfeI restriction site just prior the translation start codon and a XmaI site just past the translation stop codon respectively.

The corresponding PCR fragments were cloned into the Topo-TA cloning vector (Invitrogen) and Ampicillin resistant colonies further analysed using restriction digest analysis. Three clones confirmed of containing the insert were sequenced and one of each subjected to MfeI-XmaI restriction digest and the corresponding 784 and 942 bp fragments were gel isolated and each cloned into the MfeI-XmaI site of pMut256. This constructs were designated SICEF26 & SICEF32, respectively. Insertion of the insert into pMut256 was confirmed by 5' and 3'-end sequencing of the vector/insert boundaries.

LIP15 (Low Temperature-induced Protein 15):

A full length clone (cco1n.pk089.g17, shown in SEQ ID NO: 147) for a corn homolog of the HAP5 gene was obtained from Dupont/Pioneer EST Database. The XmaI/ApaI 0.8 kb fragment of cco1n.pk089.g17 was isolated and subcloned into pMUT256e opened by digestion with XmaI/ApaI. One clone was selected for corn transformation after restriction digestion analysis for correct insert size. Subcloning artifacts were excluded by 5' and 3' sequence of the vector-insert boundaries.

ANT (Ainitegumenta):

A full length Arabidopsis thaliana clone (adf1c.pk009.n6, same as gi 1171429, shown in SEQ ID NO: 424) for the Ainitegumenta gene was obtained from Dupont's Expressed Sequence Tag's (EST's) Database and cloned into pMut256. For this purpose the open reading frame from clone adf1c.pk009.n6 was subjected to PCR using the primers [(GGCGCCAATTGATGAAGTCTTTTTGT-GATAATGATGA and TCATACCCGGGTCAAGAAT-CAGCCCAAGCAG SEQ ID NOs: 436 and 437, respectively]. These primers introduce a MfeI restriction site just prior to the translation initiation codon and a XmaI restriction site just past the stop codon, respectively.

The PCR fragment was gel isolated and subcloned into the Topo-TA sequencing vector (Invitrogen). Ampicillin resistant colonies were further analysed using restriction digest analysis diagnostic for the presence of the Aintegumenta gene. Three clones that contained the insert were sequenced. Two out of three sequences completely agreed with the sequence of clone adf1c.pk009.n6. One of these clones was subjected to a MfeI-XmaI digest and the corresponding 1668 bp fragment was gel isolated and cloned into the MfeI-XmaI site of pMut256, which was named SIANT. Insertion of the insert into pMut256 was confirmed by 5' and 3'-end sequencing of the vector/insert boundaries.

Two additional gene expression cassettes were used for the specific expression of the *Arabidopsis* Ainitegumenta in soybean. One of them is composed of the 35 S promoter of cauliflower mosaic virus (Odell et al (1985) *Nature* 313: 810–812; Hull et al (1987) *Virology* 86:482–493) and 3' nos terminator. The other is composed of the beta-conglycinin promoter and the Phaseolin 3' terminator.

SNF1/AMPK (Sucrose Non-fermenting 1/AMP-dependent Protein Kinase, Corn Genes)

Full length clones for corn homologs of SNF1 gene (cen3n.pk0044.b8 [SEQ ID NO: 233] and p0123.cammb73r, part of the contig shown in SEQ ID NO: 239) were obtained from Dupont/Pioneer EST Database. The inserts were isolated and subcloned into pMUT256e opened by digestion with XmaI/ApaI. One clone was selected for corn transformation after restriction digestion analysis for correct insert size. Subcloning artifacts were excluded by 5' and 3' sequence of the vector-insert boundaries.

SNF1/AMPK (Sucrose Non-fermenting 1/AMP-dependent Protein Kinase, Soybean Gene).

A full length clone for a soybean homolog of the SNF1 gene obtained from clone sgs4c.pk006.n21 [SEQ ID NO: 251] also known as MRK6. The ORF of MRK6 was amplified by using the primers (5':AATTTCTAGAATGGA-CAGATCAACTGGCCG and 3':GTGATCTAGACTA-GAGAACACGTAGCTGTGAAAGGA [SEQ ID NOs: 438 and 439, respectively]) containing XbaI sites. After PCR amplification the fragment containing the complete MRK6 ORF was subcloned into pCST2 plasmid. For subcloning of MRK6 into pMUT256e, the XbaI fragmant of MRK6 was digested from pCST2, gel purified and subsequently made blunt-end by Klenow polimerase treatment. Thereafter, the blunt-ended MRK6 fragment was ligated to pMUT256e digested with SmaI. One clone showing the right insert size was selected for transformation. Subcloning artifacts were excluded by 5' and 3' sequence of the vector-insert boundaries.

ACL (ATP Citrate Lyase, Subunits 1 & 2):

Lipid biosynthesis is known to be localized in the plastids and therefore an enzyme that should resume a catalytic role in the biosynthesis of fatty acids, such as ATP Citrate lyase, has to be targeted to the plastid. Since the cloned corn ATP Citrate lyase is of cytosolic origin, it does not contain a signal peptide. A chloroplast transit sequence was therefore fused to Subunits 1 & 2 of the corn ATP Citrate lyase. The cts used was based on the small subunit of ribulose 1,5-bisphosphate carboxylase from corn (Lebrun et al (1987) *Nucleic Acid Res.*15:4360) and is designated mcts. For fusion between SU1 of ATP Citrate lyase and mcts, the transit sequence was amplified with primers (TCATAC-CCGGGTCMGMTCAGCCCAAGCAG and CCCGG-GAATTCGCACCGGATTCTTCCGCCGT [SEQ ID NOs: 440 and 441, respectively]), which introduce a MfeI site at the 5' end and XmaI and EcoRI site at the 3' end. For fusion of the SU2 of ATP Citrate lyase to the mcts, the transit sequence was amplified with primers (CAATTGATG-GCGCCCACCGTGATGAT and CCCGGGCTAGCCATG-CACCGGATTCTTCCG [SEQ ID NOs: 442 and 443, respectively]), which introduces a MfeI site at the 5' end and NheI and XmaI site at the 3' end. Each of the amplified Pcr products-was subcloned into the Topo TA sequencing vector (Invitrogen). Ampicillin resistant colonies were further analyzed for presence of the inserts using restriction enzyme digests and three clones for each insert were sequenced. One of each of the clones, whose sequence agreed completely with the published sequence of the transit peptide, was submitted to an MfeI -XmaI digest and the corresponding 158 bp fragments were gel extracted and cloned into the MfeI-XmaI site of pMut256, which then were designated pMut257 and pMut258.

A full length clone (cdo1c.pk001.cl, SEQ ID NO: 199) for Subunit 1 of the ATP citrate lyase gene was obtained from Dupont's EST database. An open reading frame encomprising nucleotides 66–1337 was amplified using Primers (CCCGGGCTAGCCATGCACCGGATTCTTCCG and CCCGGGTTACGCTGCAGCCATGATGC [SEQ ID NOs: 444 and 445, respectively]. The 1271 bp PCR fragment was gel isolated and cloned into the Topo TA cloning vector. Ampicillin resistant colonies were further analysed for the presence of the insert using restriction enzyme analysis. 3 clones positive for the insert were sequenced. One of the sequenced clones was digested with EcoRI and XmaI and the corresponding fragment was gel extracted and cloned into the EcoRI-XmaI site of pMut257. In order to put the mcts in frame with the gene for ATP Citrate lyase subunit 1, a 184 bp KasI-Bsu361 fragment, which encompasses the EcoRI cloning site between the ATP sitrate lyase subunit 1 and the transit peptide, was isolated and substituted with a 178 pb KasI-Bsu361 fragment that has been generated using PCR amplification with the primers (GGATGGCGCCCAC-CGTGATGATGGC; CGCGCCATGCACCGGATTCT-TCC; CTTCTTGCGCGCCATGCACCGGATTCT; GTACTCCCGGATCTTCTTGCGCGCCAT; CGCTTG-GAGTCGTACTCCCGGATCTTCTTG; and GCTTCCT-GAGGAGGCGCTTGGAGTCGTACTCCCG [SEQ ID NOs: 446–451, respectively]). This fragment is void of the EcoRI site. Clones containing the insert, which was verified by restriction enzyme analysis were sequenced and the absence of the EcoRI site verified.

A full length clone (ctn1c.pk002.o4, SEQ ID NO: 201) for subunit 2 of ATP Citrate lyase from corn was obtained from Dupont's EST Database. An open reading frame encompassing 1827 bp was amplified using primers ((ATG-GCTAGCGGGCMCTTTTCTCA and GTACCCCCGGGT-CACTTGGTGTAAAGTACATCCT [SEQ ID NOs: 452 and 453, respectively]). Primer with Seq. ID NO: 452 introduces a NheI restriction site, which changes the third nucleotide in the second codon after the translation start from G to T, which does not result in a change in the amino acid sequence of the protein. The primer also changes the third codon from ACG to AGC which results in a change from threonine to serine in the protein. Primer with SEQ ID NO: 453 introduces a XmaI site just past the stop codon of the Subunit 2 of the ATP citrate lyase gene. The resulting PCR fragment was subcloned into Topo TA sequencing vector (Invitrogen) and Ampicillin resistant colonies were further analyzed by restriction digest analysis and three clones positive for the insert were sequenced. All of three sequences appear to agree with the sequence of clone ctnl c.pk002.o4. One of the clones was digested with NheI and XmaI and the corresponding 1824 bp fragment was gel isolated and cloned into pMut 258. The resulting vector was called SIACL2 and presence of the insert was verified by 5' and 3'-end sequencing of the vector/insert boundaries.

MAP Kinase Kinase 3 (MAPKK3/MEK3)

A full length clone for a corn homolog of then MEK3 gene (p0125.czaab60rb:fis [SEQ ID NO: 7]) was obtained from Dupont/Pioneer EST Database. The missing 5, end of the corn MEK3 clone was amplified from a corn embryo cDNA library by PCR using a forward primer in the vector and a reverse one internal to EST clone p0125.czaab6orb:fis (GCCAAGCTCGGAATTAACCCTCA and CGCAGACC-MGCMTACTTT respectively, [SEQ ID NOs: 454 and 455, respectively]). A full length corn MEK3 was constructed by joining this PCR-amplified MEK3 5, end fragment into the pO125.czaab6orb:fis clone. The full-length MEK3 was confirmed by sequence. The coding region of the full-length MEK3 clone is PCR amplified using the primers GTTGAATTCCAGGGTGCATT and CGAAAGGMTTCT-TCTAAATCCTC [SEQ ID NOs: 456 and 457, respectively] which leaves terminal SmaI sites. The PCR product is digested with SmaI and subcloned into pMUT256e opened by digestion with SmaI. One clone is selected for corn transformation after restriction digestion analysis for correct insert size and orientation. Subcloning artifacts are excluded by 5, and 3' sequence of the vector-insert boundaries.

Example 9

Transformation of Immature Embryos By Particle Bombardment and Regeneration of Corn Plants Immature maize embryos from greenhouse donor plants are bombarded with a plasmid containing the gene of the invention operably linked to a weak promoter, such as the nos promoter, or an inducible promoter, such as ln2, plus a plasmid containing the selectable marker gene PAT (Wohlleben et al (1988) *Gene* 70:25–37) that confers resistance to the herbicide Bialaphos. Transformation is performed as follows. The ears are surface sterilized in 30% Chloral bleach plus 0.5% Micro detergent for 20 minutes, and rinsed two times with sterile water. The immature embryos are excised and placed embryo axis side down (scutellum side up), 25 embryos per plate. These are cultured on 560 L medium 4 days prior to bombardment in the dark. Medium 560 L is an N6-based medium containing Eriksson's vitamins, thiamine, sucrose, 2,4-D, and silver nitrate. The day of bombardment, the embryos are transferred to 560 Y medium for 4 hours and are arranged within the 2.5-cm target zone. Medium 560Y is a high osmoticum medium (560 L with high sucrose concentration). A plasmid vector comprising the gene of the invention operably linked to the selected promoter is constructed. This plasmid DNA plus plasmid DNA containing a PAT selectable marker is precipitated onto 1.1 µm (average diameter) tungsten pellets using a $CaCl_2$ precipitation procedure as follows: 100 µl prepared tungsten particles in water, 10 µl (1 µg) DNA in TrisEDTA buffer (1 µg total), 100 µl 2.5 M $CaCl_2$, 10 µl 0.1 M spermidine. Each reagent is added sequentially to the tungsten particle suspension, while maintained on the multitube vortexer. The final mixture is sonicated briefly and allowed to incubate under constant vortexing for 10 minutes. After the precipitation period, the tubes are centrifuged briefly, liquid removed, washed with 500 ml 100% ethanol, and centrifuged for 30 seconds. Again the liquid is removed, and 105 µl 100% ethanol is added to the final tungsten particle pellet. For particle gun bombardment, the tungsten/DNA particles are briefly sonicated and 10 µl spotted onto the center of each macrocarrier and allowed to dry about 2 minutes before bombardment. The sample plates are bombarded at level #4 in particle gun #HE34-1 or #HE34-2. All samples receive a single shot at 650 PSI, with a total of ten aliquots taken from each tube of prepared particles/DNA. Following bombardment, the embryos are kept on 560Y medium, an N6 based medium, for 2 days, then transferred to 560R selection medium, an N6 based medium containing 3 mg/liter Bialaphos, and subcultured every 2 weeks. After approximately 10 weeks of selection, selection-resistant callus clones are sampled for PCR and activity of the gene of interest. Positive lines are transferred to 288J medium, an N6 based medium with lower sucrose and hormone levels, to initiate plant regeneration. Following somatic embryo maturation (2–4 weeks), well-developed somatic embryos are transferred to medium for germination and transferred to the lighted culture room. Approximately 7–10 days later, developing plantlets are transferred to medium in tubes for 7–10 days until plantlets are well established. Plants are then transferred to inserts in flats (equivalent to 2.5" pot) containing potting soil and grown for 1 week in a growth chamber, subsequently grown an additional 1–2 weeks in the greenhouse, then transferred to classic 600 pots (1.6 gallon) and grown to maturity. Plants are monitored for expression of the gene of interest.

Example 10

Transformation of Callus and Regeneration of Corn Plants—Particle Gun.

Type II Callus Isolation and Maintenance.

After 10–21 days, type 11 callus is initiated from the scutellum and appears as a friable, embryogenic outgrowth of rapidly dividing cells. Callus is subcultured every 5–10 days and maintained on N6 medium supplemented with 1 mg/L 2,4-D (CM). These cultures are used in transformation experiments from 5 to 12 weeks after initiation.

Preparation of Callus for Transformation.

Proembryogenic type II callus is transferred to #4 Whatman filter paper on CM media. The CM plates with callus is wrapped with parafilm and incubated in the dark Conviron growth chamber (45% humidity, 27–28° C.) for two days before bombardment. Prior to bombardment, the osmotic plates are left partially ajar for thirty minutes in the laminar flow hood to allow moisture on the tissue to dissipate.

Gold Particle Preparation

Sixty mg of 0.6 micron gold is weighed out in a siliconized eppendorf tube (Axgen Microtubes—1.7 ml clear tube). The tube is left stationary for 15 minutes and spun down. The pellet is rinsed with sterile water three more times. Subsequently, one ml of sterile water is added to the gold pellet and vortexed for 10 minutes. The gold particles are divided into 50 ul aliquots.

DNA/Gold Preparation

Fifty µL of 0.6 micron gold in sterile dd H20. A 2:1 molar ratio of trait gene:bar gene (usually ~5–10 ug in total DNA) is added and vortexed. Subsequently, fifty µL of 2.5 M $CaCl_2$ is added quickly into the suspension and vortexed followed by the addition of 20 µL of 0.1 M spermidine and vortexed and spun down. The pellet is rinsed 3× in 100% ethanol. The pellet is gently resuspended by tapping the side of the eppendorf tube several times. The DNA prep is stored in the 20° C. freezer.

Loading of the Macrocarrier

The DNA/gold prep is thawed and sonicated (2 strokes) in the Branson 200 Ultrasonic cleaner prior to the addition to macrocarriers. The suspension is mixed well by pipetting in and out. Immediately, 6 µl of DNA/gold suspension is dispensed quickly to the center of each macrocarrier. Once the DNA prep is dried onto the macrocarrier, the PDS-100/He Gun is used to bombard the maize callus cells with the DNA-coated gold particles.

Particle Gun Parameters.

Plates containing callus are the bombarded with the PDS-1000/He Gun using the following parameters: 1) DNA precipitated onto 0.6 µM Gold particles; 2) 8 cm distance from stopping screen; 3) 27–29 inches Hg vacuum; 4) 1050–1100 PSI He pressure.

Selection of Transgenic Callus Lines.

After 3–4 days of incubation in the dark chamber the callus is transferred (3–4 mm clumps) onto media containing 3–5 ppm bialaphos (SM3 or SM5). The SM plates are incubated in the dark at 27° C. for ~7–14 days. Thereafter, all callus is transferred onto SM (5 ppm bialaphos) keeping track of unique lines as above. Each clump may be split into several pieces at this transfer.

Regeneration of Transgenic Maize Plants.

Callus events are isolated onto fresh SM medium, sampled for PCR (polymerase chain reaction) and placed on first-stage regeneration media (RM31). After 10–14 days, the proembryogenic callus are transferred onto fresh RM3 plates and placed in the light chamber at 26° C. Plantlets approximately 2–3 cm are removed and transfer to RM4 media tubs. After 1–2 weeks plants from RM4 are potted to a maximum of two plantlets per pot. The pots are then placed in the Conviron growth chamber (photolight=20 hours, humidity=65%, temperature=24° C.) and watered with Roots2 solution. Plants (~20 cm tall) are tested for expression of the bar gene by performing a 2% basta swipe test.

Example 11

Analysis of Fatty Acid Content and Composition by Gas Chromatography (GC)

Fatty acid (FA) determination was done from a total of 300–400 mg of tissue lyophilized for 24 hours. The tissue was then ground using a FastPrep mill (Bio101) at 4.5 speed and 20 seconds in the presence of 0.5 ml of 2.5% Sulfuric Acid+97.5% Methanol and Heptadecanoic acid (17:0, stock 10 mg/ml in Tuloene) as an external standard. Thereafter, another 0.5 ml 2.5% Sulfuric Acid+97.5% Methanol was used to wash each tube and incubate in 95° C. for 1 hour for transesterification. The tubes were removed from the water bath and allowed to cool down to RT. FAs were extracted in one volume of heptane:$H_2O$ (1:1) and cleared by centrifugation. The supernatant (50 ul) containing the fatty acid methyl esters were loaded into a Hewlett Packard 6890 gas chromatograph fitted with a 30 m×0.32 mm Omegawax column and the separated peaks were analyzed and characterized.

Example 12

Lec 1 Over-expression Leads to Altered Fatty Acid Accumulation in Maize Somatic Embryos The ubiquitin promoter (Christensen et al (1992) *Plant Mol Biol* 18:675–89) was used to drive Hap3/Lec1 expression (outlined in Example 8) in maize embryogenic callus to test what phenotype would arise from over-expression of Lec1 in somatic embryos. Transformation of the construct into maize embryogenic callus and generation of somatic embryos is outlined in Example 10.

More than ten different events were analysed by GC for fatty acid content/composition and compared to controls transformed with the selectable marker (BAR gene) plasmid alone. A pool of three embryos each from XX different events showed that the somatic embryos overexpressing Lec1 contain elevated fatty acid content (average 119% increase over control) with no significant alteration in fatty acid composition when compared to the control somatic embryos (FIG. 1).

Example 13

Nuclear Magnetic Resonance (NMR) ANALYSIS

Seed are imbibed in distilled water for 12–24 hours at 4° C. The embryo is dissected away and stored in a 48 well plate. The samples are lyophilized over-night in a Virtis 24×48 lyophilizer. The NMR (Process Control Technologies—PCT (Ft. Collins, Colo.) is set up as per the manufacturer's instructions. The NMR is calibrated using a series of 5 mm NMR tubes containing precisely measured amounts of corn oil (Mazola). The calibration standards are 3, 6, 9, 12, 15, 18, 21, 27, 33, and 40 mg of oil.

Example 14

Lec 1 Over-expression Leads to Altered Oil Accumulation in Maize Kernels

The Hap3/Lec1 expression construct with the oleosin promoter (outlined in Example 8) was introduced into maize to test what phenotype would arise from seed specific over-expression. Transformation of the construct into maize was accomplished using *Agrobacterium tumefaciens* as follows.

Freshly isolated immature embryos of maize, about 10 days after pollination (DAP), are incubated with the Agrobacterium. The preferred genotype for transformation is the highly transformable genotype Hi-II (Armstrong, C. L., 1991, Development and Availability of Germplasm with High Type II Culture Formation Response, *Maize Genetics Cooperation Newsletter*, 65:92–93). An $F_1$ hybrid created by crossing with an Hi-II with an elite inbred may also be used. After Agrobacterium treatment of immature embryos, the embryos are cultured on medium containing toxic levels of herbicide. Only those cells which receive the herbicide-resistance gene, and the linked gene(s), grow on selective medium. Transgenic events so selected are propagated and regenerated to whole plants, produce seed, and transmit transgenes to progeny.

The engineered *Agrobacterium tumefaciens* LBA4404 is constructed as per U.S. Pat. No. 5,591,616 to contain the linked gene(s) and the selectable marker gene. Typically either BAR (D'Halluin et al (1992) *Methods Enzymol.* 216:415–426) or PAT (Wohlleben et al (1988) *Gene* 70:25–37) may be used.

To use the engineered vector in plant transformation, a master plate of single bacterial colonies is first prepared by inoculating the bacteria on minimal AB medium and then incubating the bacteria plate inverted at 28° C. in darkness for about 3 days. A working plate is then prepared by selecting a single colony from the plate of minimal A medium and streaking it across a plate of YP medium. The YP-medium bacterial plate is then incubated inverted at 28° C. in darkness for 1–2 days.

*Agrobacterium* for plant transfection and co-cultivation is prepared 1 day prior to transformation. Into 30 ml of minimal A medium in a flask is placed 50 µg/ml spectinomycin (or appropriate bacterial antibiotic depending on marker in co-integrate), 100 µM acetosyringone, and about a ⅛ loopful of *Agrobacterium* from a 1 to 2-day-old working plate. The *Agrobacterium* is then grown at 28° C. at 200 rpm in darkness overnight (about 14 hours). In mid-log phase, the *Agrobacterium* is harvested and resuspended at 3 to 5×10$^8$ CFU/ml in 561 Q medium+100 µM acetosyringone using standard microbial techniques and standard curves.

Immature Embryo Preparation

Nine to ten days after controlled pollination of a corn plant, developing immature embryos are opaque and 1–1.5 mm long and are the appropriate size for Agro-infection. The husked ears are sterilized in 50% commercial bleach and 1 drop Tween for 30 minutes, and then rinsed twice with sterile water. The immature embryos are aseptically removed from the caryopsis and placed into 2 ml of sterile holding solution comprising of 561Q+100 µM acetosyringone.

Agrobacterium Infection and Co-cultivation of Embryos

Holding solution is decanted from excised immature embryos and replaced with prepared *Agrobacterium*. Following gentle mixing and incubation for about 5 minutes, the *Agrobacterium* is decanted from the immature embryos. Immature embryos are then moved to a plate of 562P medium, scutellum surface upwards, and incubated at 20° C. for 3 days in darkness followed by incubation at 28° C. for 3 days in darkness on medium 562P+100 mg/ml carbenecillin (see U.S. Pat. No. 5,981,840).

Selection of Transgenic Events

Following incubation, the immature embryos are transferred to 563O medium for selection of events. The transforming DNA possesses a herbicide-resistance gene, in this example the PAT gene, which confers resistance to bialaphos. At 10- to 14-day intervals, embryos are transferred to 563O medium. Actively growing putative transgenic embryogenic tissue is visible in 6–8 weeks.

Regeneration of $T_0$ Plants

Transgenic embryogenic tissue is transferred to 288W medium and incubated at 28° C. in darkness until somatic embryos matured, or about 10 to 18 days. Individual matured somatic embryos with well-defined scutellum and coleoptile are transferred to 272 embryo germination medium and incubated at 28° C. in the light. After shoots and roots emerge, individual plants are potted in soil and hardened-off using typical horticultural methods.

Confirmation of Transformation

Putative transgenic events are subjected to analysis to confirm their transgenic nature. Events are tested for the presence of Lec1 by PCR amplification. Additionally, $T_0$ plants are painted with bialaphos herbicide. The subsequent lack of a herbicide-injury lesion indicates the presence and action of the herbicide resistance gene. The plants are monitored and scored for altered Lec1 expression and/or phenotype such as increased organic sulfur compounds.

Media Recipes

Medium 561 Q contains the following ingredients: 950.000 ml of D-1 Water, Filtered; 4.000 g of Chu (N6) Basal Salts (Sigma C-1416); 1.000 ml of Eriksson's Vitamin Mix (1000× Sigma-1511); 1.250 ml of Thiamine.HCL.4 mg/ml; 3.000 ml of 2, 4-D 0.5 mg/ml (No. 2A); 0.690 g of L-proline; 68.500 g of Sucrose; and 36.000 g of Glucose. Directions are: dissolve ingredients in polished deionized water in sequence; adjust pH to 5.2 w/KOH; Q.S. to volume with polished deionized water after adjusting pH; and filter sterilize (do not autoclave).

Medium 562 P contains the following ingredients: 950.000 ml of D-1 Water, Filtered; 4.000 g of Chu (N6) Basal Salts (Sigma C-1416); 1.000 ml of Eriksson's Vitamin Mix (1000× Sigma-1511); 1.250 ml of Thiamine.HCL.4 mg/ml; 4.000 ml of 2, 4-D 0.5 mg/ml; 0.690 g of L-proline; 30.000 g of Sucrose; 3.000 g of Gelrite, which is added after Q.S. to volume; 0.425 ml of Silver Nitrate 2 mg/ml #; and 1.000 ml of Aceto Syringone 100 mM #. Directions are: dissolve ingredients in polished deionized water in sequence; adjust pH to 5.8 w/KOH; Q.S. to volume with polished deionized water after adjusting pH; and sterilize and cool to 60° C. Ingredients designated with a # are added after sterilizing and cooling to temperature.

Medium 563 O contains the following ingredients: 950.000 ml of D-1 Water, Filtered; 4.000 g of Chu (N6) Basal Salts (Sigma C-1416); 1.000 ml of Eriksson's Vitamin Mix (1000× Sigma-1511); 1.250 ml of Thiamine.HCL.4 mg/ml; 30.000 g of Sucrose; 3.000 ml of 2,4-D 0.5 mg/ml (No. 2A); 0.690 g of L-proline; 0.500 g of Mes Buffer; 8.000 g of Agar (Sigma A-7049, Purified), which is added after Q.S. to volume; 0.425 ml of Silver Nitrate 2 mg/ml #; 3.000 ml of Bialaphos 1 mg/ml #; and 2.000 ml of Agribio Carbenicillin 50 mg/ml #. Directions are: dissolve ingredients in polished deionized water in sequence; adjust to pH 5.8 w/koh; Q.S. to volume with polished deionized water after adjusting pH; sterilize and cool to 60° C. Ingredients designated with a # are added after sterilizing and cooling to temperature.

Medium 288 W contains the following ingredients: 950.000 ml of D-1 $H_2O$; 4.300 g of MS Salts; 0.100 g of Myo-Inositol; 5.000 ml of MS Vitamins Stock Solution (No. 36J); 1.000 ml of Zeatin.5 mg/ml; 60.000 g of Sucrose; 8.000 g of Agar (Sigma A-7049, Purified), which is added after Q.S. to volume; 2.000 ml of IAA 0.5 mg/ml #; 1.000 ml of 0.1 Mm ABA #; 3.000 ml of Bialaphos 1 mg/ml #; and 2.000 ml of Agribio Carbenicillin 50 mg/ml #. Directions are: dissolve ingredients in polished deionized water in sequence; adjust to pH 5.6; Q.S. to volume with polished deionized water after adjusting pH; sterilize and cool to 60° C. Add 3.5 g/L of Gelrite for cell biology. Ingredients designated with a # are added after sterilizing and cooling to temperature.

Medium 272 contains the following ingredients: 950.000 ml of deionized water; 4.300 g of MS Salts; 0.100 g of Myo-Inositol; 5.000 of MS Vitamins Stock Solution; 40.000 g of Sucrose; and 1.500 g of Gelrite, which is added after Q.S. to volume. Directions are: dissolve ingredients in polished deionized water in sequence; adjust to pH 5.6; Q.S. to volume with polished deionized water after adjusting pH; and sterilize and cool to 60° C.

Medium minimal A contains the following ingredients: 950.000 ml of deionized water; 10.500 g of potassium phosphate dibasic K2HPO4; 4.500 g of potassium phosphate monobasic KH2PO4; 1.000 g of ammonium sulfate; 0.500 g of sodium citrate dihydrate; 10.000 ml of sucrose 20% solution #; and 1.000 ml of 1 M magnesium sulfate #. Directions are: dissolve ingredients in polished deionized water in sequence; Q.S. to volume with deionized water; sterilize and cool to 60° C. Ingredients designated with a # are added after sterilizing and cooling to temperature.

Medium minimal AB contains the following ingredients: 850.000 ml of deionized water; 50.000 ml of stock solution 800A; 9 g of Phytagar which is added after Q.S. to volume; 50.000 ml of stock solution 800B #; 5.000 g of glucose #; and 2.000 ml of spectinomycin 50/mg/ml stock #. Directions are: dissolve ingredients in polished deionized water in sequence; Q.S. to volume with polished deionized water less 100 ml per liter; sterilize and cool to 60° C. Ingredients designated with a # are added after sterilizing and cooling to temperature. Stock solution 800A contains the following ingredients: 950.000 ml of deionized water; 60.000 g of potassium phosphate dibasic K2HPO4; and 20.000 g of sodium phos. monobasic, hydrous. Directions are: dissolve ingredients in polished deionized water in sequence; adjust pH to 7.0 with potassium hydroxide; Q.S. to volume with polished deionized water after adjusting pH; and sterilize and cool to 60° C. Stock solution 800B contains the following ingredients: 950.000 ml of deionized water; 20.000 g of ammonium chloride; 6.000 g of magnesium sulfate 7-$H_2O$, MgSO$_4$, 7 $H_2O$; 3.000 g of potassium chloride; 0.200 g of calcium chloride (anhydrate); and 0.050 g of ferrous sulfate 7-hydrate. Directions are: dissolve ingredients in polished deionized water in sequence; Q.S. to volume with polished deionized water; and sterilize and cool to 60° C.

Medium minimal YP contains the following ingredients: 950.000 ml of deionized water; 5.000 g of yeast extract (Difco); 10.000 g of peptone (Difco); 5.000 g of sodium chloride; 15.000 g of bacto-agar, which is added after Q.S. to volume; and 1.000 ml of spectinomycin 50 mg/ml stock #. Directions are: dissolve ingredients in polished deionized water in sequence; adjust pH to 6.8 with potassium hydroxide; Q.S. to volume with polished deionized water after adjusting pH; sterilize and cool to 60° C. Ingredients designated with a # are added after sterilizing and cooling to temperature.

More than twenty events producing segregating T1 seed were analyzed by NMR for embryo oil content (see Example 13). Six to twelve embryos analyzed for each of five different events showed that some embryos within each event contained elevated oil content. These results are shown in FIG. 2. The same embryos from these five events were analyzed by PCR to determine the presence or absence of the Lec1 construct. Embryos with high oil are always found to contain the Lec1 construct (darkly shaded bars), whereas embryos with normal levels of oil were typically found not to contain the Lec1 construct (cross-hatched bars). These data demonstrate the presence of the Lec1 gene does lead to increased oil in the embryo. It is believed that embryos containing sharply higher levels of oil were homozygous for the Lec1 construct, as these events were segregating 1:2:1. For these events, the oil concentration in the embryos containing the Lec1 construct greatly surpassed any increase previously achieved through enzymatic modification of the fatty acid biosynthetic pathway, with some embryos containing an average increase of 56% in embryo oil content (FIG. 2, Event 277267). Plants derived from seed that contained high oil exhibit some phenotypic changes in growth and development. There is an accumulation of additional leaves during early growth and development phase, and strong leaf curling throughout plant growth and development.

Example 15

Additional Promoters Coupled to Lec1 Also Result in Altered Maize Kernel Oil Accumulation Other types of seed-specific promoters, the lipid transfer protein promoter and the gamma zein promoter, were also tested for their ability to alter oil accumulation in maize kernels when expressing Lecd. Transformation and analysis of these constructs was essentially the same as protocols outlined in Example 14. More than twenty events producing segregating T1 seed are analyzed by NMR for embryo oil content (see Example 13). Six to twelve embryos were analyzed for each event. Events containing embryos with high oil content were analyzed further. The same embryos from these events are analyzed by PCR to determine the presence or absence of the Lec1 construct. As with the oleosin promoter containing construct, all embryos with high oil contents are found to contain the Lec1 construct, whereas embryos with lower or normal oil contents are typically found not to contain the Lec1 construct. Like the events containing Lec1 and the oleosin promoter, the oil concentration in the embryo for these events also greatly surpass any increase previously achieved through enzymatic modification, with some embryos containing an average increase of more than 50% in embryo oil content.

Surprisingly, plants derived from seed containing high oil using this construct do not show the abnormal phenotype found for plants expressing Lec1 under the control of the oleosin promoter. It is believed that these data demonstrate that high oil can be achieved in the embryo without negative agronomic effects when the appropriate expression is employed.

SEQUENCE LISTING (532 sequences)

SEQ ID NO: 1 - DNA, 516 bp, Zea mays
gcacgagacagcttcggcgtggtgctgctggagatcctgatcggccggaggtccgtggaggcggagtacggcgagggaagcaacatcgtggactggacgaggcgtaaggtcgccgccggcaacgtgatggacgcggcggagtgggcggaccagcagacccgcgaggcggtgcgggacgagatggcgctggcgctgcgggtggcgctgctctgcaccagccggtgcccgcaggagcggccgtcgatgagggacgtcgtgtccatgctgcaggaggtcaggcgcggccggaagctactggctcctgggatggccaagaagcagccaaagattaattagcaaccaccacgtgtgttacgacttgcgtgtaggtgtattattgtactactactcactatgaaatgcgtacttaatttgtcgtgtagtcatgtcatgtataatgtcttactagatcactcatcactgtatgagtacattaaagtttcaagactttcagaggtcaaaaaaaaaaaaaaaaaa

SEQ ID NO: 2 - protein, 111 aa, Zea mays
ARDSFGVVLLEILIGRRSVEAEYGEGSNIVDWTRRKVAAGNVMDAAEWADQQTREAVRDEMALALRVALLCTSRCPQERPSMRDVVSMLQEVRRGRKLLAPGMAKKQPKIN

SEQ ID NO: 3 - DNA, 470 bp, Zea mays
  unsure (248): n = A, C, G, or T
atcagaggatgcttgtatatgagtatgttgataatgggaacttagaacaatggctgcacggggatgttgggcccagaagccctctcgcctgggatgacaggatgaagatcatactgggaacagcaaaagggttaatgtatttgcacgaggggcttgaaccaaaggtggttcaccgtgatgtcaagtcaagcaacatccttctggacaagcaatggaatgctaagctctcggatttcggacttgcgaantttcttggttcagaaaggagttatgtcaccacaagagttatgggaactttcgggtatgttgctccagagtacgcagggactgggatgttgaatgaaacaagcgacatatatagttttgggattcttataatggagataatatccggtagggtaccagtggattataataggccaccaggagaggttaatttagttgattggcttaagacgatggtaagcccc

SEQ ID NO: 4 - protein, 155 aa, Zea mays
  UNSURE (82): Xaa = any amino acid
QRMLVYEYVDNGNLEQWLHGDVGPRSPLAWDDRMKIILGTAKGLMYLHEGLEPKVVHRDVKSSNILLDKQWNAKLSDFGLAXFLGSERSYVTTRVMGTFGYVAPEYAGTGMLNETSDIYSFGILIMEIISGRVPVDYNRPPGEVNLVDWLKTMVS

SEQ ID NO: 5 - DNA, 521 bp, Zea mays
  unsure (1): n = A, C, G, or T
  unsure (7): n = A, C, G, or T
  unsure (51): n = A, C, G, or T
  unsure (54): n = A, C, G, or T
  unsure (59): n = A, C, G, or T
  unsure (66): n = A, C, G, or T
  unsure (68): n = A, C, G, or T
  unsure (89): n = A, C, G, or T
  unsure (115): n = A, C, G, or T
  unsure (134): n = A, C, G, or T
  unsure (139): n = A, C, G, or T
  unsure (144): n = A, C, G, or T
  unsure (166): n = A, C, G, or T
  unsure (203): n = A, C, G, or T
  unsure (205): n = A, C, G, or T
  unsure (239): n = A, C, G, or T
  unsure (316): n = A, C, G, or T
  unsure (323): n = A, C, G, or T
  unsure (329): n = A, C, G, or T
  unsure (339): n = A, C, G, or T
  unsure (341): n = A, C, G, or T
  unsure (347): n = A, C, G, or T
  unsure (350): n = A, C, G, or T
  unsure (352): n = A, C, G, or T
  unsure (359): n = A, C, G, or T
  unsure (375): n = A, C, G, or T
  unsure (379): n = A, C, G, or T
  unsure (425): n = A, C, G, or T
  unsure (516): n = A, C, G, or T
  unsure (521): n = A, C, G, or T
naagctncaacccttgctgttcgatgacctggacagagttggcgccagtancanggtgnccttacnanaagatacttgcgattcctacncagtttctgatggtgggactgttaanttacttagtagatccttgngtgantatanaatcaatgagcatggctttcanaaacgaagtgctgggccagacgagttagattctgatnanaaggcttaccgttgtgcctctcatgatatgcatntatttggtcccatcggtaatggtgcaagcagtgtagtggagagagctatatttattccacgttcatcgaatcttggncttgaanaagatnaacatattcnanaacganaanangcaacanattctgaatgacatgngaanattatgtgaagcatgttgttatcctggtttagttgaattccagggngcattttacatgcctgattctggacaaataagtatcgctcttgaatacatggatggtggttccttggcatatgttataaggggtcaagaantctan

SEQ ID NO: 6 - protein, 84 aa, Zea mays
  UNSURE (7): Xaa = any amino acid
  UNSURE (15): Xaa = any amino acid
  UNSURE (22)..(23): Xaa = any amino acid
  UNSURE (25): Xaa = any amino acid
  UNSURE (32): Xaa = any amino acid
  UNSURE (45): Xaa = any amino acid
  UNSURE (57): Xaa = any amino acid
DTCDSYXVSDGGTVXLLSRSLXXYXINEHGFXKRSAGPDELDSDXKAYRCASHDMHXFGPIGNGASSVVERAIFIPRSSNLGLE

SEQ ID NO: 7 - DNA, 1372 bp, Zea mays
ccacgcgtccggaacattatgtgaagcatgttgttatcctggtttagttgaattccagggtgcattttacatgcctgattctggacaaataagtatcgctcttgaatacatggatggtggttccttggcagatgttataagggtcaagaagtctataccagaaccagttctttcacatatgctacagaaagtattgcttggtctgcgatacttgcatgaagtaaggcatctagtgcatagagatataaagccagcaaatttactggtaaatcttaagggcgaggcgaagattacagattttggtgtgagtgctggtttggacaatacaatggctatgtgtgctacctttgtaggcacagtcacatatatgtcacctgagagaattcgtaatgagaactattcttatgctgctgatatttggagtcttggactaacaatattggaatgtgctactggaaaattcccatatgacgtaaatgagggccctgcaaatctaatgttgcagatacttgatgatccatcaccaacaccaccagtagatacttgttcattagaattctgctcattcatcaatgattgcttgcagaaagatgctgatgcaaggcccacatgtgagcagcttctgtcacacccattcatcaagaggtatgcaggaactgaagtggacttggcagcatatgtcaaaagtgtagttgacccaacagaaaggctaaagcaaatagctgagatgcttgctatacattactacctcttgtttaatggacctgatgggatttggcatcatatgaagacattctacatggaacaatctactttcagtttctcagagaacgtgtatgttggccagaatgaaatttttgatattttgtcaaatataaggaaaaagctaaaaggtgataggcctcgagagaaaattgttcatgttgtcgagaagctacattgtcgtgcaaatggtgaaactggggttgcaattcgtgtgtctggatctttcattgtgggaaaccaatttcttgtatgtggcgaggggataaaagctgaagggatgcctagcttggatgagctctctattgacattccaagcaaacgcgtaggccagttcagagagcagtttatcatgcaaccgggaaacttaatgtcatgctattacatatcaaagcaagatctgtacattatccaatcctgattgaacatattatttgtaagattattctctgaagcacatgtatagaggatttagaagaattcctttcggacctggttttgaatcttatttactttgtggaactgaaattttgggccaaacctctgacaagaattgaaaagtttaagtcttcaactatattcatgtttaaaaaaaaaaaaaaaaaaaaag

SEQ ID NO: 8 - protein, 554 aa, Zea mays
RTSSPGKVTAATSAFQGTAIQKQGPWPQRTWMAGLEELKKKLQPLLFDDLDRVGASTRVPLPEDTCDSYAVSDGGTVNLLSRSLGEYKINEHGFHKRSAGPDELDSDEKAYRCASHEMHIFGPIGNGASSVVERAIFIPVHRILALKKINIFEKEKRQQILNEMRTLCEACCYPGLVEFQGAFYMPDSGQISIALEYMDGGSLADVIRVKKSIPEPVLSHMLQKVLLGLRYLHEVRHLVHRDIKPANLLVNLKGEAKITDFGVSAGLDNTMAMCATFVGTVTYMSPERIRNENYSYAADIWSLGLTILECATGKFPYDVNEGPANLMLQILDDPSPTPPVDTCSLEFCSFINDCLQKDADARPTCEQLLSHPFIKRYAGTEVDLAAYVKSVVDPTERLKQIAEMLAIHYYLLFNGPDGIWHHMKTFYMEQSTFSFSENVYVGQNEIFDILSNIRKKLKGDRPREKIVHVVEKLHCRANGETGVAIRVSGSFIVGNQFLVCGEGIKAEGMPSLDELSIDIPSKRVGQFREQFIMQPGNLMSCYYISKQDLYIIQS

SEQ ID NO: 9 - DNA, 430 bp, Oryza sativa
  unsure (358): n = a, c, g, or t
aaaaaaagaagaaacaaagagagaagaattccaaggaccaagaaatcgaggcaatggctaagcagctcaggcgggtgcgcacgctgggccgcggggcgtccggcgccgtggtgtggctcgcgtccgacgacgactcaggggagctcatggccgtcaagtcggcctccgccggcggcgccgcggcgcagctgcggcgagaggggcgtgtcctgtccgggctctgctcgccgcacatcgtcccctgcctcggatcgcgcgccgccgcgggcggcgagtaccagctgttcctcgagttcgcgcccggcgggtcgctcgccgacgaggccgccaggaacgggggctgcctcccggagccggncatccgggcgtacgccgctgacgtggcgagggggctggcgtacctccacgggaattcctggtgcacggcgac

SEQ ID NO: 10 - protein, 142 aa, Oryza sativa
  UNSURE (119): Xaa = any amino acid
KKKKQREKNSKDQEIEAMAKQLRRVRTLGRGASGAVVWLASDDDSGELMAVKSASAGGAAAQLRREGRVLSGLCSPHIVPCLGSRAAAGGEYQLFLEFAPGGSLADEAARNGGCLPEPXIRAYAADVARGLAYLHGNSWCTA

SEQ ID NO: 11 - DNA, 515 bp, Oryza sativa
  unsure (464): n = a, c, g, or t
  unsure (477): n = a, c, g, or t
  unsure (501): n = a, c, g, or t
cttacatatagctaagccccccaagagacatcgagagcgagatcgccatggccgccgccgccgccgcggcggaggcggcgatgctgaggagggagcgggggatgatgtctgggctgtcctcgccacacgtcgtgccctgcatcggcggcggcgatggccccgacgggtcatacaatctcttccttgagttcgcccccgggggatcgctcgccaacgaggttgccagggatgggggacgcctcgaggagcgcgcgatcagggtgtacgcggcggatgtcctgcgcgggctgacgtacctccacgggatgtcgctcgtacacggggatgtcaaggcggacaacatagtgatcggtgtcgacgggctcgccaagctcgccgacttcgggtgtgcgaaaaccatggattcggagcgggcggtcagcggcacacctgcgttcaaggcgccggaggttgcccgcggggangaacaagggccancggcaaacgtttggggctcttggntgaacgtcatccag

SEQ ID NO: 12 - protein, 156 aa, Oryza sativa
  UNSURE (139): Xaa = any amino acid
  UNSURE (144): Xaa = any amino acid
  UNSURE (152): Xaa = any amino acid
MAAAAAAAEAAMLRRERGMMSGLSSPHVVPCIGGGDGPDGSYNLFLEFAPGGSLANEVARDGGRLEERAIRVYAADVLRGLTYLHGMSLVHGDVKADNIVIGVDGLAKLADFGCAKTMDSERAVSGTPAFKAPEVARGXEQGPXANVWGSWXNVIQ

SEQ ID NO: 13 - DNA, 1282 bp, Glycine max
gcacgaggagaaacacgcacatcatcttacatacataccactgttcacaaccatgaattgggttcgcggagagcctctcggcagtggcagtttcgccaccgtcaacatagccataccgacaaacacttccactcagtttctttcttccaccgccgtcaaatcctcctatgttcacacctcgtctatgctgaaaaacgagaaggaaatactcgattgccttggagcttccccttatgtcattaactgtttcggcgacgatcacacggttgaaaacggagaagagtattacaacattttccttgaatacgccgcaggtggttctctcgctgatcaggtaaaaaaacacggagggaggctcccggagtcttacgttcggcgttgtacgaggtcgctcgtcgaaggtctaaaacatattcacgacaacggttatgttcactgcgatgtgaagcttcaaaacattctcgttttccagaatggggatgttaaaatcgcggattttgggcttgcaaaggagaaaggggaaaaacaggggaaattggagtgccggggaacaccgctgtttatgtctccggaatcggtgaacgacaatgagtatgaatcgccggcggatatatgggcccttggctgcgccgtcgtggagatgctgactggaaaacccgcatgggatgttcgcgggtcgaatatctggtcgttgttgattcgaattggagcgggagaagaattgcccaagattccagaagagttatcagaagagggaaaagattttcttttgaagtgtttcgttaaggatccaatgaagaggtggagcgctgagatgcttttgaatcaccctttcgtcaacggtgaaaccgtttcgtttcagaaagttaatgagccgttgccgttaccgtcgccgtcaccgaggacacactttgatttaactcactgggcttccaccgtaacggcgttgcttccgtcttccccggattctgatgagtggcgtatgtgggaatccgggtcgtcgtgttcgccggagaatagactccggcggcttgtaaccgttcagacgccggcgaattggtcagaatcggatggctggacaagcgttaggtgaagtacttggaagtgcagcgttgattgttccatggtcatcagatcttacggctcacattcgatcacgttcgttgattctttgtatttcattagttctgaattaagtagagataggaggattgctagccgccacctttggccaagtgtacagagattcatttggttaatatcacaattttgtttctttaaa

SEQ ID NO: 14 - protein, 360 aa, Glycine max
EKHAHHLTYIPLFTTMNWVRGEPLGSGSFATVNIAIPTNTSTQFLSSTAVKSSYVHTSSMLKNEKEILDCLGASPYVINCFGDDHTVENGEEYYNIFLEYAAGGSLADQVKKHGGRLPESYVRRCTRSLVEGLKHIHDNGYVHCDVKLQNILVFQNGDVKIADFGLAKEKGEKQGKLECRGTPLFMSPESVNDNEYESPADIWALGCAVVEMLTGKPAWDVRGSNIWSLLIRIGAGEELPKIPEELSEEGKDFLLKCFVKDPMKRWSAEMLLNHPFVNGETVSFQKVNEPLPLPSPSPRTHFDLTHWASTVTALLPSSPDSDEWRMWESGSSCSPENRLRRLVTVQTPANWSESDGWTSV

SEQ ID NO: 15 - DNA, 510 bp, Glycine max
  n = a, c, g, or t
  unsure (255): n = a, c, g, or t
  unsure (435): n = a, c, g, or t
  unsure (450): n = a, c, g, or t
  unsure (459): n = a, c, g, or t
  unsure (477): n = a, c, g, or t
  unsure (489): n = a, c, g, or t
  unsure (498): n = a, c, g, or t
  unsure (500): n = a, c, g, or t
  unsure (510): n = a, c, g, or t
attgagtttttgggcttctcacttctttttttctttcacactctcaacgaagtgatttataacagtgtttaattgaaattccaaacatggattgggttcgaggagacgctgtcggacgaggaagctttgctaccgttagtttagctattccaacgacgaattacaatcagtttccgtctctaaccgtggttaagtccgctgacgctcaaacctcgtgctggctcagaaacgagaaacacgtgctggatcgcctangttcgtgtccgaggataattcgctgcttcggagatgactgcagtttcgagaacggcgtcgagtactacaatttgttcctcgaatacgccgccggcgggagtctcgccgacgaattgaggaaccacgatggcaggattcccgaagcctcaaggctccgggaatacacaaggggaacaaccntggaagggtttgagnccacgttgnacaaaaaaacgggtttgntcaacggggaanattaaggcngnagaaaatccn

SEQ ID NO: 16 - protein, 124 aa, Glycine max
  UNSURE (57): Xaa = any amino acid
  UNSURE (117): Xaa = any amino acid
  UNSURE (122): Xaa = any amino acid
MDWVRGDAVGRGSFATVSLAIPTTNYNQFPSLTVVKSADAQTSCWLRNEKHVLDRLXSCPRIIRCFGDDCSFENGVEYYNLFLEYAAGGSLADELRNHDGRIPEASRLREYTRGTTXEGFEXTL

SEQ ID NO: 17 - DNA, 638 bp, Catalpa speciosa
  unsure (402): n = A, C, G, or T
  unsure (520): n = A, C, G, or T
  unsure (526): n = A, C, G, or T
  unsure (539): n = A, C, G, or T
  unsure (542): n = A, C, G, or T
  unsure (558): n = A, C, G, or T
  unsure (563): n = A, C, G, or T
  unsure (581): n = A, C, G, or T
  unsure (609): n = A, C, G, or T
  unsure (619): n = A, C, G, or T
  unsure (622): n = A, C, G, or T
  unsure (629)..(630): n = A, C, G, or T
  unsure (632): n = A, C, G, or T
gtgctctttaaaattcacaagtacatctgacctctacatcaacacacattgactctaaattctctctctaaattctgtcaacccccaaattctagggttttgttttaattgtcatcagatttcgccttaacaggacacattggttgatttctttgggagaaattaggggagcatgcaatccaagtcccagagcggcaaccaaggagaatccaacctttataatgttcctaactccaaagtaaatccggattcttggtggaataatactgggatataatccttttcctcaacaatgatggggtgggaaatgcatcaagattcatcatccctagaacaatctgtgggatggacaagtcgcagtctaaaggtggtataaatgaggaagatgatgatactaccaanacgatcacaaagttagtacacctccggctgccaagatagaaactataggcaggagggccgagctccagcaagctccacctaccaatacatccaaagaaacaatgggatcgttaatcanggccanagttgagctgggnggnatcagtagctgggggncaaancctaagatcatatacggnggaagatggaactaaggcagcatggtcncccaattaanganagcacannanggtgga

SEQ ID NO: 18 - protein, 77 aa, Catalpa speciosa
  UNSURE (35): Xaa = any amino acid
  UNSURE (76): Xaa = any amino acid
MQSKSQSGNQGESNLYNVPNSKVNPDSWWNNTGIXSFSSTMMGGNASRFIIPRTICGMDKSQSKGGINEEDDDTTXT

SEQ ID NO: 19 - DNA, 441 bp, Typha latifolia
  unsure (378): n = A, C, G, or T
  unsure (415): n = A, C, G, or T
atttaggagagagcttgaggtcgagaggagcagcagaggaggaaggaggcaggagaagcaaagggtttcgagaaaggggacatgctccccttataaggacatggaaaccagaaagcaactaggtcatccattgctgaagcaagactcattttcaaatgtcaactaatctgttccaccaagaagcatcggtaatgggtgaagaccaccttagtgagaagcatacttcaacacaatctgggaatgctggtagttatggaaatataagggatggttatccaaaatcagtattatccttggcaaatccagaagctgcctttgtacctccgaaacttgattgtagccagtcttttacttgcatgccatacccttttgctgatncatgctttggtggtgtcatggctgcatatggttcgcnatgcctttattcaacaacaaatggtg

SEQ ID NO: 20 - protein, 95 aa, Typha latifolia
  UNSURE (75): Xaa = any amino acid
  UNSURE (87): Xaa = any amino acid
MSTNLFHQEASVMGEDHLSEKHTSTQSGNAGSYGNIRDGYPKSVLSLANPEAAFVPPKLDCSQSFTCMPYPFADXCFGGVMAAYGSXCLYSTTNG

SEQ ID NO: 21 - DNA, 849 bp, Vitis sp.
ctgaggttgcagagacaccatggattcccaccaacggccatgatttccttccaaactcctaccttttagggtttattcctctgctctcatcccacattagatttggggctaggggatttttgtttttcttggtggaaaagaataatgccgactaaacccaaaattgaggatcggcggatagaacctggtggtaagagcaatccgtcatcaacagtctactcccaaccttggtggcatggtgttgggaacaatgccatctccccagctgccttgggtggaagcccatcaaaatcaacttcagttgaacaccttaacagtcatatcacgagcaatggtttccaattacaagctaatggcaggctggatgatggaactacctttaataaaggaacacaacctacggtagccctgcaatctgatggaaggaatggacaggaacaccagcacctcaatcctactgcttcctcaacactgccaattatgagtgaacatcttgaaccaaattcccaaatggaacttgttggtcactcaattgtgttgacatcatatccgtatcaagatccacataatgtggggattatgacttcttatgggccacaggctatggtatgcaaagaagttggttgcatttctgtgtgttgtggtaacattactgttggtggcactaccacttctgaaagtgatgcctcaaccttgaaaactagattctcctgtactagggcctgcccctcttataggggaggtcagccactgtagtgaataatctgtttcataagaaaatcatcagtttttatgtgaaggttccttcttctagatttggtctcgcccaagaaaaaaaaaaaaaaaaaa

SEQ ID NO: 22 - protein, 154 aa, Vitis sp.
MPTKPKIEDRRIEPGGKSNPSSTVYSQPWWHGVGNNAISPAALGGSPSKSTSVEHLNSHITSNGFQLQANGRLDDGTTFNKGTQPTVALQSDGRNGQEHQHLNPTASSTLPIMSEHLEPNSQMELVGHSIVLTSYPYQDPHNVGIMTSYGPQAM

SEQ ID NO: 23 - DNA, 1334 bp, Vitis sp.
ctcatttgaaaatccgtagaccgaaccatggacttcgtatccatcattcttctctctccatagctcctcaattctagggtttctctcactcttcttcctctctgaatggaagctgtggacaagaacaaaagcatcctcagcaagctgtatcaatgatgcctatgactatggctgaataccaccttgcaccaccttcccagctggaacttgttggccactcaattgcgtgtgcatcatatccatattctgaaccttattacacgggagtcattcctgcttatggacctcagggtttggtacaatctcaatttcttggtgtgaatgtggctagaatggctttgcctattgaaatggcagaggaacctgtttatgtgaatgcaaaacagtatcatgggattctgaggcgaagacaatcacgggcgaaggccgagctggaaaaaaaactgataaaagttaggaagccatatcttcatgaatcaaggcaccagcatgctatgagaagggcaagaggatgtggaggccgttttctcaacacaaagaagcttgattctaatgcatcgtatgacatgcctgacaagggctctgatccagatgtaaacctttcaacacgacccatcagctcatcagtctctgaatctctgccctccaattcttcccgaaatgaggattcccccaccagtcatctagatgcaagaggtccctctgtgcaggaattgcacaataggcaaacagcctcccatggaaatggcaacagctgttatccacacaaccagggatttcagttgtcgacataccattcccttaaagatgatcgcgtggaagaaggagaccacgcagggcggcagcatgagagaattctggtgaatagggccccccacagggccctaaccatcaaatgaaaccttcgttgctaagggatgaagggtctttccagcattgctctgatctattgcagatggcatcagcttccatgtgggcttgagggtgtcacagaagtgggctagttcaaatacaaaaataagtgaggagcatccttctgtgacttctactcaagtatctggtaacggatccggatggcagcattgcagggcaaagctggaagcattaccccaaccaatcagaggggggggggacccctggcctatgtgttgtattttcaggcaaatcattcttggcttgtatttttcatattcctgtgtttgttggaccgggggggaaagacagagagattgggaatcgtctaatttcactcattacctttttggaaaaaaaaaaaaaaaaaaaaaaaaaaaaaaaaaaaaaaaaaaaaaaaaaaaaaaaaaaaaaaaaaaaaa

SEQ ID NO: 24 - protein, 261 aa, Vitis sp.
CGQEQKHPQQAVSMMPMTMAEYHLAPPSQLELVGHSIACASYPYSEPYYTGVIPAYGPQGLVQSQFLGVNVARMALPIEMAEEPVYVNAKQYHGILRRRQSRAKAELEKKLIKVRKPYLHESRHQHAMRRARGCGGRFLNTKKLDSNASYDMPDKGSDPDVNLSTRPISSSVSESLPSNSSRNEDSPTSHLDARGPSVQELHNRQTASHGNGNSCYPHNQGFQLSTYHSLKDDRVEEGDHAGRQHERILVNRAPHRALTIK

SEQ ID NO: 25 - DNA, 987 bp, Vitis sp.
gcacgagggaaggtcaaagtcaaatgaagccagttttctttatggctaatccagatgttgtcttcaatccttcacaagttgactatggccattctgtgactcatgttgcatatccttatgctgatccttaccatggggggttagtggctgcatatggtccacatgctgttattcagccccagctggtggggatagcacctaccagagtcccactgccctttgatattgcagaggatggacctatttttgtcaatgcaaaacagtatcatggaattctcaggaggaggcagtcacgagcaaagatggaggcccagaacaaacttgtcaaagcccgaaagccatatctgcacgagtctcggcatcttcatgccctaaatagggttagaggatctggtggacgcttcctcagcacgaaaaagctccaagaaccggactcaacttccaatgctggctgtcatagtgtatctggctctggtcattttcaccagaagggagacacaactgagcagccggagcacaggttctcaggcatgtctccccacatgggtggagccatgcaaggtggtggcggtgggacttatgggcaatggagtcctgctcctggttgtccggtgagaagtcgataggaacaagatcgatggagtcactggtctgggcaattcatccttggctttgttactttcgtttcatgcgtgttaagaagataaacacatcaaacttcatggtgtagtagaaatactctgcctttcccatttccaaatgcatacattttggctctgtaaacatggttgagaagaggctatgcttgaaactctctgtttgtgaaccattgttttgttttttcaagacaatgtgagatattggttcaccggtattttgtttgttgcttacagaaagcaaaccctgccttttgtgcttaaaaaaaaaaaaaaaaaaaaaaaaaaaaaaaaaaaaaaaaaaaaaaaaaaaaaaaaaaaaaaaaaaaaa

SEQ ID NO: 26 - protein, 205 aa, Vitis sp.
EGQSQMKPVFFMANPDVVFNPSQVDYGHSVTHVAYPYADPYHGGLVAAYGPHAVIQPQLVGIAPTRVPLPFDIAEDGPIFVNAKQYHGILRRRQSRAKMEAQNKLVKARKPYLHESRHLHALNRVRGSGGRFLSTKKLQEPDSTSNAGCHSVSGSGHFHQKGDTTEQPEHRFSGMSPHMGGAMQGGGGGTYGQWSPAPGCPVRSR

SEQ ID NO: 27 - DNA, 1256 bp, Zea mays
gcacgagctctgtctgtgtgcgagcgcaagagaaagggagtcagagagagagggaggagaccttgcagaggagcgaagcaagcaaggtgggaaagaggcagcaagggcggcgggctgccggaaggggaacatgctccctcctcatctcacagtacgaactgaaaaacaagagtaaagaatttccgtgagatgagacagaatggcgcggtgatgattcagtttggccatcagatgcctgattacgactccccggctacccagtcaaccagtgagacgagccatcaagaagcgtctggaatgagcgaagggagcctcaacgagcataataatgaccattcaggcaaccttgatgggtactcgaagagtgacgaaaacaagatgatgtcagcgttatccctgggcaatccggaaacagcttacgcacataatccgaagcctgaccgtactcagtccttcgccatatcatacccatatgccgatccatactacggtggcgcggtggcagcagcttatggcccgcatgctatcatgcaccctcagctggttggcatggttccgtcctctcgagtgccactgccgatcgagccagccgctgaagagcccatctatgtcaacgcgaagcagtaccacgctattctccggaggagacagctccgtgcaaagctagaggcggaaaacaagctcgtgaaaagccgcaagccgtacctccacgagtctcggcacctgcacgcgatgaagagagctcggggaacaggcgggcggttcctgaacacgaagcagcagccggagtcccccggcagcggcggctcctcggacgcgcaacgcgtgcccgcgaccgcgagcggcggcctgttcacgaagcatgagcacagcctgccgcccggcggtcgccaccactatcacgcgagagggggcggtgagtagggagccccgacactggcaactcatccttggcttatcagcgattcgactcggctctcgctcgtctgaaactgaactctctgcaactactgtaactgtaactaaactgggtgtgcccggattggcggtcgttctgttctactactactagtaccttagtacctgctacgcgtcgttgggtctggactagagagccgtgctggttctttgatgaacttggctggacttgaggtgttgactagcgcgaaactgagttccatgtaaacttttgcttcaagaccgatgactggcggcataataagtagcagtaataaccaaaaaaaaaaaaaaaaaaa

SEQ ID NO: 28 - protein, 244 aa, Zea mays
MRQNGAVMIQFGHQMPDYDSPATQSTSETSHQEASGMSEGSLNEHNNDHSGNLDGYSKSDENKMMSALSLGNPETAYAHNPKPDRTQSFAISYPYADPYYGGAVAAAYGPHAIMHPQLVGMVPSSRVPLPIEPAAEEPIYVNAKQYHAILRRRQLRAKLEAENKLVKSRKPYLHESRHLHAMKRARGTGGRFLNTKQQPESPGSGGSSDAQRVPATASGGLFTKHEHSLPPGGRHHYHARGGGE

SEQ ID NO: 29 - DNA, 1203 bp, Zea mays
ccacgcgtccggcaagagaaagggagtcagagagagagagagagggaggagaccttgcagaggagcgaagcaagcaaggtgggaaagaggcagcagcaagggcggcgggctgccggaaggggaacatgctccctcctcatctcacagagaatggcgcggtgatgattcagtttggccatcagatgcctgattacgactccccggctacccagtcaaccagtgagacgagccatcaagaagcgtctggaatgagcgaagggagcctcaacgagcataataatgaccattcaggcaaccttgatgggtactcgaagagtgacgaaaacaagatgatgtcagcgttatccctgggcaatccggaaacagcttacgcacataatccgaagcctgaccgtactcagtccttcgccatatcatacccatatgccgatccatactacggtggcgcggtggcagcagcttatggcccgcatgctatcatgcaccctcagctggttggcatggttccgtcctctcgagtgccactgccgatcgagccagccgctgaagagcccatctatgtcaacgcgaagcagtaccacgctattctccggaggagacagctccgtgcaaagctagaggcggaaaacaagctcgtgaaaagccgcaagccgtacctccacgagtctcggcacctgcacgcgatgaagagagctcggggaacaggcgggcggttcctgaacacgaagcagcagccggagtcccccggcagcggcggctcctcggacgcgcaacgcgtgcccgcgaccgcgagcggcggcctgttcacgaagcatgagcacagcctgccgcccggcggtcgccaccactatcacgcgagagggggcggtgagtagggagccccgacactggcaactcatccttggcttatcagcgattcgactcggctctccctcgtctgaaactgaactctctgcaactactgtaactgtaactaaactgggtgtgcccggattggcggtcgttctgttctactactagtacctgctacgcgtcgttgggttgggtctggactagagagcgtgctggttctttgatgaacttggctggacttgagggtgttgactagcgcgaagctgagttccatgtaaaacttttgcttcaagaccgatgactggcggcataataagtagcagtaataaccaaaaaaaaaaaaaaaaaaag

SEQ ID NO: 30 - protein, 288 aa, Zea mays
PARERESEREREGGDLAEERSKQGGKEAAARAAGCRKGNMLPPHLTENGAVMIQFGHQMPDYDSPATQSTSETSHQEASGMSEGSLNEHNNDHSGNLDGYSKSDENKMMSALSLGNPETAYAHNPKPDRTQSFAISYPYADPYYGGAVAAAYGPHAIMHPQLVGMVPSSRVPLPIEPAAEEPIYVNAKQYHAILRRRQLRAKLEAENKLVKSRKPYLHESRHLHAMKRARGTGGRFLNTKQQPESPGSGGSSDAQRVPATASGGLFTKHEHSLPPGGRHHYHARGGGE

SEQ ID NO: 31 - DNA, 1301 bp, Zea mays
gcacgagccagtgcgacggccacggcctgagcggcgctgccagcaaggcggctagtatgagcagcatggagtcgcggccgggccgaacgaacctggtggagcccatagggcacggcgccgcgctgccgtccggcggccaggcagtgcagccgtggtggacgagctccggggctgtgctcggtgcagtctcgccagccgtcgtggcggtggcgcccgggagcgggacggggattagcctgtcgagcagcccggcaggtggtagtggtggtggcggcgcggctaaaggagccgcgagtgacgagagcagcgaggattcacggagatctggggaaccaaaagatggaagcgctagtcaagaaaagaaccatgccacatcgcagatacccgctctggcgccagagtatttggcaccatactcgcagctggaactgaaccaatcaattgcttctgcagcatatcagtacccagatccttactatgcaggcatggttgctccctatggaagtcatgctgtggctcattttcagctacctggactaactcaatctcgaatgccattacctcttgaagtatccgaggagcctgtttatgtaaatgccaagcagtaccatggtatcttaagacgacggcagtcccgtgctaaggctgaacttgagaaaaaggtggtcaaagccagaaagccataccttcacgagtctcgtcatcagcacgcgatgaggagggcaagaggaaacgggggacgcttcctgaacacaaagaaaagtgacagtggtgctcccaatggaggcgaaaacgccgagcatctccatgtccctcccgacttactacagctacgacagaacgaggcttgaagtagcggtatggctctggcatccttgaacagcagttcctgtccacgggcgtaggcattcgagaccggattcatatagctctccacagcatacgcgcagccatctctgcggtaacgcacgttctcctgaacgagctttgtagcgagataggtatgcaagtgcaatctgggcgcaggaatccatcatcaagtgcccaatgcccatggggtaggtacgctgtttcaggcaattcattcttggctttcacgttccacccttgtgtaactggtgtgttgtaaatgtgtggaaaactaagcttgtgctctgtatcgggccgttcagcggaactgcaaaacgcctgtataattaagatcgaactttggattaactcggtaatgctttgtctggttttcttttaaaaaaaaaaaaaaaaaaaaaaaaaaaaaaaaaaacaaaaaaaaaaaaaaaaaa

SEQ ID NO: 32 - protein, 264 aa, Zea mays
MSSMESRPGRTNLVEPIGHGAALPSGGQAVQPWWTSSGAVLGAVSPAVVAVAPGSGTGISLSSSPAGGSGGGGAAKGAASDESSEDSRRSGEPKDGSASQEKNHATSQIPALAPEYLAPYSQLELNQSIASAAYQYPDPYYAGMVAPYGSHAVAHFQLPGLTQSRMPLPLEVSEEPVYVNAKQYHGILRRRQSRAKAELEKKVVKARKPYLHESRHQHAMRRARGNGGRFLNTKKSDSGAPNGGENAEHLHVPPDLLQLRQNEA

SEQ ID NO: 33 - DNA, 1258 bp, Zea mays
gcacgaggccacgccgccggccacgccccagacgaccccgcccgccgccgccgcctcccgctccctccgcgcgcagccctcgtccggccgcccgggtccgagcgcgctcgctcctcctccccacgtcggacagtttaagtgtggcttcattgcatgagtagttgcagttagcgtggcttttctccgtgcttgctcctggtcgtgctttgccttgcaaaggaaggaatcatgacatctgttgttcacagtgtttcaggtgaccacagggctgaggatcaaaatcaacagaagaagcaagctgaacctggggaccagcaagaagccccagttactagttcagatagccaaccaacagtaggcacaccatcaacagattatgtggcaccctatgcccctcatgacatgagccatgcaatgggtcaatacgcttatccaaatattgacccatactatggaagcctttatgcagcagcttacggtggacagccattgatgcatccaccgttagttggaatgcatccggctggcttacctttgcctaccgatgcaattgaagagcctgtgtatgtaaatgcaaagcaatacaatgccatattaagacggcgtcaatctcgggctaaagctgaatcagaacgaaagcttatcaaggggcgtaagccctatctccatgagtcacgtcatcagcatgccttgaaaagggccaggggagctggaggtcggtttctcaactcaaagtcagatgacaaggaagagaactccgactcgagtcacaaagagaatcagaacggagttgcgccccacaggagcggccaaccgtcaacccctccgtctcccaacggtgcatcgtcagctaatcagggcaggcagtcgtgaatgatggatgattcaaaactcacagctgaagagatttcagcccctgagctagatatggcagcagttttgtacagaaaacgctagcaacatggtgtcggtcggtcggtcggttgttgtaggacatgttccatagaaaaagcatagacgagtctacaggttttggagccttggtttggtcctctgtgtattcacctttctgtacaatcttagtagcgttgtgtaccttcccctggaaggaaggatagcttcagttagcgcttcagaaagtcaagtgtgtagcatattggcttattgtttgctttgcttggacaatggagatttgggagtggagttcataaccctgctgaataaatactcttagctggctaaaaaaaaaaaaaaaaaa

SEQ ID NO: 34 - protein, 214 aa, Zea mays
MTSVVHSVSGDHRAEDQNQQKKQAEPGDQQEAPVTSSDSQPTVGTPSTDYVAPYAPHDMSHAMGQYAYPNIDPYYGSLYAAAYGGQPLMHPPLVGMHPAGLPLPTDAIEEPVYVNAKQYNAILRRRQSRAKAESERKLIKGRKPYLHESRHQHALKRARGAGGRFLNSKSDDKEENSDSSHKENQNGVAPHRSGQPSTPPSPNGASSANQGRQS

SEQ ID NO: 35 - DNA, 1170 bp, Zea mays
gcacgagccacgccgtcggccacgccccgacgaccaacacctgctccctccgccgccgcccgtgtcctcccgctccgtccgcgcgccgccctcatacctccaagcgcggttggatctgctctgggtccaagtccgctcgatcctcctctcgtcggaaactttatgtgtgccttcatccacgaagagctgaagatatcacatgactagttgcagttagtgtggcttttctccctgcttggtcctgattgtgtgctttgccttgcaaaggaaggaatcatgacctctgttgttcagagcgtttcaggtgaccacagggctgaggatcaaagtcatcagaagaagcaaactgaacctggggaccagcaagaagccccagttactagttcagatagccaaccaacagtgggcacaccatcaacagattatgtggcaccctatgcccctcatgacatgagccatgcaatgggtcaatatgcttatccaaatattgatccatactatggaagtctttatgcggcggcttatggtggacatccattgatgcatccaacattagtcggaatgcatccggctggcttacctttgcctaccgatgcaattgaagagccagtgtatgtaaatgcaaagcaatacaatgccatattaagacggcgtcaatctcgggctaaagctgaatcagaacggaagcttgtcaagggccgcaagccctatctccatgagtcacggcatcagcatgccttgaaaagggccaggggagctggaggtcggtttctcaattcgaagtcagatgacaaggaagagaactccgactcaagtcaaaaagagattcagaacggagttgcgccccaaaagggtggccaaccgtcaacccctccgtctcccaacggtgcgtcgtcagcttatcaggcgcctagtcgtgaatgatgattcggaactcacaactgaagagattttagtccctgacgctagttgtggcagcagctttgtacagtaagtgctagcgggcagcagcgaaatggtgtcatagaaaaacgttgacgagtcagacaggttttggagtcttggttttttttcctctgtttattttacctgtctgcaattttagtagctttgtgtcccttcccctggatagttttttggtcagcgcttaagaaaaaaaaaaaaaaaaaa

SEQ ID NO: 36 - protein, 215 aa, Zea mays
MTSVVQSVSGDHRAEDQSHQKKQTEPGDQQEAPVTSSDSQPTVGTPSTDYVAPYAPHDMSHAMGQYAYPNIDPYYGSLYAAAYGGHPLMHPTLVGMHPAGLPLPTDAIEEPVYVNAKQYNAILRRRQSRAKAESERKLVKGRKPYLHESRHQHALKRARGAGGRFLNSKSDDKEENSDSSQKEIQNGVAPQKGGQPSTPPSPNGASSAYQAPSRE

SEQ ID NO: 37 - DNA, 1892 bp, Zea mays
ccacgcgtccgcccgctggggctgggctacctcgttcgcttcgctgcctctgcctactcctctctcccctctttctccgctcatgtgctggtccatcgtctgcctcctcggtttgtcctgaatccttggacagacgcacacaggctcagctcaggcggttgctggatcctttggcgttccccatccggccaagaatcctgcaagagcctgcttggagttggagccggccaaacctgctgccgtcgacgtctcgggcgaggcagccttgagcatcagtctccttgacgaggcaagcaggccatgatgagcttcaagggacacgaggggttcggtcaggtgtccggagccgggatgagccaggcctcccatggcgccgcgcctgccggagccccgctgccgtggtgggctggggcccagctgctgtccggcgagccggcgcccctgtccccggaggaggcgccccgggacacccagttccaggtcgtgccgggggcctctcagggcacgccggatccagcgccgcccaagggagggacacctaaggtcctcaagttctctgtgttccaagggaatttggagtcgggtggtaaaggagagaaaaccccaaagaactctaccgctgtcgttctgcagtcgccattcgcggaatacaatggtcgtttcgagatcggtctcggtcaatctatgctggtcccttccagttattcttgtgctgaccagtgctatggcatgcttacgacttatggaatgagatccatgtctggtgggagaatgctgttgccactaattgcgccagccgatgcacccgtttatgtgaacccgaaacagtacgaaggcatcctccgtcgtcgccgtgctcgcgctaaggcggagagcgagaacaggctcaccaaaggcagaaagccttatctccatgagtcgcgccacctccacgcgatgcgccgggtgagaggctccggcgggcgcttcctcaacacgaataaaggagggcacggcacggacgttgctgcaaacgggggcagcaagatggcggcggcggcggcaccatcccgtctcgccatgccccctagcgctgagcctccatggctgtcagggctcagcgacggcagcaacccgtgctgccactcccggagtagtgtctccagcttgtccgggtcctacgtggcgagcatctacggtggcttggagcagcacctccgggcgccgcccttcttcaccccgctgccgcccgtcatggacggcgaccacggcggccccacggccgccaccatctcctccttcaagtgggcggccagcgacggctgctgcgagctcctcagggcgtgaaccgaggagggaggggatggctactcagacgaacggccttctccccgatggctggttgtctgtaggcaaatcattcttggctgttctgcattggggtgcgacctacacatcatccgcctaccgtacctaccccacccgtgtccctgaaattccagggtgcttgggttacttacaggggtcttgtgtggtgatgtggctcccccatatgcatttgctgtaacatagcgtacccaaaccactgttgcttggtacttctcgctatcactgcctcatcagtatggattctgcatttctgcgttgtcacagtgtatgaataattgaggcgtcagacttcagggttgctccagttcttggagataggtctgggtttgtttgaagcttgcctggaggtctgaaactttgtgtttggtgaagatgctacgttattgcagtttgaatctgtaagtttgggatcagcattcagttgttgcatcgtctgtgctctggtgccgaggtgttcgttctgaatatttgattcaattcaaaatcttcagctaagttactactgggacaaaaaaaaaaaaaaa

SEQ ID NO: 38 - protein, 341 aa, Zea mays
MMSFKGHEGFGQVSGAGMSQASHGAAPAGAPLPWWAGAQLLSGEPAPLSPEEAPRDTQFQVVPGASQGTPDPAPPKGGTPKVLKFSVFQGNLESGGKGEKTPKNSTAVVLQSPFAEYNGRFEIGLGQSMLVPSSYSCADQCYGMLTTYGMRSMSGGRMLLPLIAPADAPVYVNPKQYEGILRRRRARAKAESENRLTKGRKPYLHESRHLHAMRRVRGSGGRFLNTNKGGHGTDVAANGGSKMAAAAAPSRLAMPPSAEPPWLSGLSDGSNPCCHSRSSVSSLSGSYVASIYGGLEQHLRAPPFFTPLPPVMDGDHGGPTAATISSFKWAASDGCCELLRA

SEQ ID NO: 39 - DNA, 323 bp, Zea mays
  unsure (201): n = A, C, G, or T
  unsure (244): n = A, C, G, or T
  unsure (276): n = A, C, G, or T
  unsure (279): n = A, C, G, or T
  unsure (296): n = A, C, G, or T
  unsure (320): n = A, C, G, or T
acgccatcatgcgtcggcgctgtgcccgtgccaaagcagagagggaaaataggctggtcaaaggcaggaagccatatctccatgagtcacgccatcagcatgcactgcgtcgcccgcgaggctctggcggacgcttcctgaacacaaagaaagaatccagcgggaaggatgctggtggtggcagcaaggcaatgtttcaancaaccccctcatgcgccaggtggcgttctcccaagctccaaanatccaccagtccagacctgggccaaccccgancancgttttccacctgttcnggtttccaaagttttttcaacctnttt

SEQ ID NO: 40 - protein, 77 aa, Zea mays
  UNSURE (67): Xaa = any amino acid
AIMRRRCARAKAERENRLVKGRKPYLHESRHQHALRRPRGSGGRFLNTKKESSGKDAGGGSKAMFQXTPSCARWRSP

SEQ ID NO: 41 - DNA, 1195 bp, Zea mays
gcaccagaccagaggaagggacggcggggaggtggcaaggcgcagagagcaggttcgcttggcggacgcaccgagggaggcgtgtgggagccatgcttcttccgtcttcgtcttcgtcttccgcttccgcttccgcttccaaaggtaactcctttgggaaaaccgttaacgatcatctgaggtcaactttgagttttgataacaagcaacctccatttgcaagtcaaaactttgactacggtcaaacaatagcttgcatttcatacccgtacaatcattctggctcaggagatgtctgggcagcctatgagtcacgcaccagcgctgccactgtgttccgttcccaaattgctggtgggggtacatccacaagaattcccttgcctttggaattagcagagaatgaacccatatatgtgaatcccaaacaatatcacgggatacttcgcagaagacagttacgtgccaagttagaggctcagaacaagctagtcagagcccgaaagccttaccttcatgagtctaggcatcttcatgcaatgaagagggcacgaggttccggtggacgattcctcaacactaagcagctccagcagtctcacactgccctcaccaggtccaccaccacaagtggcacaagctcctcaggctcaactcatctgcggcttggtggtggcgcagccgcagctggagatcgatctgtgctggcacccaaaacaatggcctcacaagacagtagcaagaaggccgtttcttcagccctcgccttcactgcgactccaatgctgcgcagagatgacggcttcttgcagcacccaagccatcttttcagtttttctggtcattttgggcaggcaagcgcgcaagctggcgtccataatggaagtcagcatagggttccagttatgagatgaccggtttgcgaaccatagctggtgatccaggcgtctagggtcaacttcgctgtggtgtcttagtctctcaggcaattcatccttggcttaatttctggctttttattagaaggtaccaaaatgtgttccataccgttgtggccacagagcccataaaccagggggtttgatggttggcactcctacccaaactattgtcttgttgcagtggtgtttgttagaataaaccttgactattattctgtacaaaaaaaaaaaaaaaaaaaaaaaaaaaaaaaaaa

SEQ ID NO: 42 - protein, 273 aa, Zea mays
MLLPSSSSSSASASASKGNSFGKTVNDHLRSTLSFDNKQPPFASQNFDYGQTIACISYPYNHSGSGDVWAAYESRTSAATVFRSQIAGGGTSTRIPLPLELAENEPIYVNPKQYHGILRRRQLRAKLEAQNKLVRARKPYLHESRHLHAMKRARGSGGRFLNTKQLQQSHTALTRSTTTSGTSSSGSTHLRLGGGAAAAGDRSVLAPKTMASQDSSKKAVSSALAFTATPMLRRDDGFLQHPSHLFSFSGHFGQASAQAGVHNGSQHRVPVMR

SEQ ID NO: 43 - DNA, 1376 bp, Zea mays
tctctatctatctatacggttcaagggactgaagaaggtagagagagaaactcgaaggggagaggacagaagagggagatacaggttaatttttaggtaccagatcatctgatttctcagaagcaaaatgttgtttggagctcagtgacaccatcttgtaatgcctgtgattttacgggaaatggaggatcattctgtccatcccatgtctaagtctaaccatggctccttgtcaggaaatggttatgagatgaaacattcaggccataaagtttgcgatagggattcatcatcggagtctgatcggtctcaccaagaagcatcagcagcaagtgaaagcagtccaaatgaacacacatcaactcaatcagacaatgatgaagatcatgggaaagataatcaggacacaatgaagccagtattgtccttggggaaggaaggctctgcctttttggccccaaaattacattacagcccatcttttgcttgtattccttatactgctgatgcttattatagtgcggttggggtcttgacaggatatcctccacatgccattgtccatccccagcaaaatgatacaacgaacactccgggtatgttacctgtggaacctgcagaagaaccaatatatgttaatgcaaaacaataccatgcaatccttaggaggaggcaaacacgtgctaaattggaggcccagaacaagatggtgaaaaatcggaagccatatcttcatgagtcccgacatcgtcatgccatgaaacgggctcgtggatcaggaggacggttcctcaacacaaagcagctccaggagcagaaccagcagtatcaggcatcgagtggttcattgtgctcaaagatcattgccaacagcataatctcccaaagtggccccacctgcacgccctcttctggcactgcaggtgcttcaacagccggccaggaccgcagctgcttgccctcagttggcttccgccccacgacaaacttcagtgaccaaggtcgaggaggcttgaagctggccgtgatcggcatgcagcagcgtgtttccaccataaggtgaagagaagtgggcacaacaccattcccaggcacactgcctgtggcaactcatccttggctcttggaactttgaatatgcaatcgacatgtagcttgagatcctcagaataaaccaaaccttcagttatatgcaagccttttttgaggttgctgttgctgtacctgagaactgtggttaggttatgagtttgttcctcaaaactgacccatacatgacatgctaccttgtgctgagtttctgagacaaagccatcgaaacatgatcttgtggttcagtaaaaaaaaaaaaaaaaaaaaaaaaaaaaaaaaaaaaa

SEQ ID NO: 44 - protein, 300 aa, Zea mays
MPVILREMEDHSVHPMSKSNHGSLSGNGYEMKHSGHKVCDRDSSSESDRSHQEASAASESSPNEHTSTQSDNDEDHGKDNQDTMKPVLSLGKEGSAFLAPKLHYSPSFACIPYTADAYYSAVGVLTGYPPHAIVHPQQNDTTNTPGMLPVEPAEEPIYVNAKQYHAILRRRQTRAKLEAQNKMVKNRKPYLHESRHRHAMKRARGSGGRFLNTKQLQEQNQQYQASSGSLCSKIIANSIISQSGPTCTPSSGTAGASTAGQDRSCLPSVGFRPTTNFSDQGRGGLKLAVIGMQQRVSTIR

SEQ ID NO: 45 - DNA, 1492 bp, Zea mays
gcacgagctcacttgcttcgacgtatttctcaatctatctatacggttcaagggaccgaagaaggtagagagagaaacttgaaggggagaggaaggagatacaggttcatgttcatttaggtgtcagttcatctgatttctcagaagcaaaatgttgtttggagctcagtgacaccatcttgtaatgcatgtgccttttacgggaaatggaggatcattctgtccatccaaagtctaagtctaaccatggttccttgtcaggaaatggttatgagatgaaaaatccaggccatgaagtttgtgatagggattcatcatcagagtctgatcgatctcacccagaagcatcagcagtgagtgaaagcagtctagatgaacacacatcaactcaatcagacaatgatgaagatcatgggaaggataatcaggacacattgaagccagtattgtccttggggaaggaagggtctgcctttttggccccaaaaatagattacaacccgtcttttccttatattccttatactgctgacgcttactatggtggcgttggggtcttgacaggatatgctccgcatgccattgtccatccccagcaaaatgatacaacaaatagtccggttatgttgcctgcggaacctgcagaagaagaaccaatatatgtcaatgcaaaacaataccatgcaatccttaggaggaggcagacacgtgctaaactggaggcgcagaacaagatggtgaaaggtcggaagccataccttcatgagtctcgacaccgtcatgccatgaagcgggcccgtggctcaggagggcggttcctcaacacaaagcagcagctccaggagcagaaccagcggtaccaggcgtcgagtggttcaatgtgctcaaagaccattggcaacagcgtaatctcccaaagtggccccatttgcacgccctcttctgacgctgcaggtgcttcagcagccagccaggaccgcggctgcttgccctcggttggcttccgccccacagccaacttcagtgagcaaggtggaggcggctcgaagctggtcatgaacggcatgcagcagcgtgtttccaccataaggtgaagagaagtgggcacgacaccattcccaggcgcgcactgcctgtggcaactcatccttggcttttgaaactatggatatgcaatggacatgtagcttcgagttcctcagaataaccaaacgtgaagaatatgcaaagtccttttgagatttgctgtagctgaaagaactgtggttaggttgagtttcttcctggagactgatccatacatgacatgctacctcgtgctgagtttctgaggtgaagccatcgaaacatgaccgtgtggttcagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 46 - protein, 301 aa, Zea mays
MCLLREMEDHSVHPKSKSNHGSLSGNGYEMKNPGHEVCDRDSSSESDRSHPEASAVSESSLDEHTSTQSDNDEDHGKDNQDTLKPVLSLGKEGSAFLAPKIDYNPSFPYIPYTADAYYGGVGVLTGYAPHAIVHPQQNDTTNSPVMLPAEPAEEEPIYVNAKQYHAILRRRQTRAKLEAQNKMVKGRKPYLHESRHRHAMKRARGSGGRFLNTKQQLQEQNQRYQASSGSMCSKTIGNSVISQSGPICTPSSDAAGASAASQDRGCLPSVGFRPTANFSEQGGGGSKLVMNGMQQRVSTIR

SEQ ID NO: 47 - DNA, 725 bp, Zea mays
  unsure (546): n = A, C, G, or T
  unsure (554): n = A, C, G, or T
  unsure (636): n = A, C, G, or T
  unsure (671): n = A, C, G, or T
  unsure (697): n = A, C, G, or T
gcagcaaacactagggtaccattgccagttgggcctgcagcagaggaacccatatttgtcaatgcaaagcaatacaatgctatcctccggaggaggcaaaaacgcgcaaaactggaggcccaaaataaactggtgaaaggtcggaagccatatctccatgaatctcggcatcgtcatgcaatgaagcgagtccgtggaccagggcgtttcctcaacaaaaaggagctccaggagcagcagctgaaggcactgccttcacttcagactccaacaggtggggtcagcaaaatggcctttggcaggaacctatgccctgaaagcagcacatctcactcgccttcgacgagctctacaatctcgagtgcttcaaactggagtggcacgctagctcatcaagagcacgttagcttcgcatctgctaataaattcctccccagcatgaacttccacgcggagaatggagtgaaaagatggccatcaatggcgtccgccaccacacccctgtcctgagtgaacaaccttcaactgtgggggtgctgtgctggnaccatcantgggcgcgctccgtgtgcccgtggcaattcatcttggcttatgatgtatcttatagttaatttgctttcactttcatatggnacttgtctcagattaaactcgtgatatttattgcnactgggatgactggaaataatctcangtttcttaccaaaaaaaaaaaaaaaaaa

SEQ ID NO: 48 - protein, 169 aa, Zea mays
AANTRVPLPVGPAAEEPIFVNAKQYNAILRRRQKRAKLEAQNKLVKGRKPYLHESRHRHAMKRVRGPGRFLNKKELQEQQLKALPSLQTPTGGVSKMAFGRNLCPESSTSHSPSTSSTISSASNWSGTLAHQEHVSFASANKFLPSMNFHAENGVKRWPSMASATTPLS

SEQ ID NO: 49 - DNA, 831 bp, Zea mays
ccacgcgtccgcatatatgtgaatcccaaacaatatcacgggatacttcgcagaagacagttacgtgccaagctagaggctcagaacaagctagtcagagcccgaaagtcttaccttcatgagtctaggcatcttcatgcaatgaagagggcacgaggttccggtggacgattcctcaacactaagcagctccagcagtctcacacagccctcaccaggtccaccaccacaagtggcacaagctcctcaggctcaactcatctgcggcttggtggtggcgcagccgcagctggagatcgatctgtgctggcacccaaaacaatggcctcacaagacagtagcaagaaggccgtttcttcagccctcgccttcactgcgactccaatgctgcgcagagatgacggcttcttgcagcacccaagccatcttttcagtttttctggtcattttgggcaggcaagcgcgcaagctggcgtccataatggaagtcagcatagggttccagttatgagatgaccggtttgcgaaccatagctggtgatccaggcgtctagggtcaacttcgctgtggtgtcttagtctctcaggcaattcatccttggcttaatttctggctttttattagaaggtaccaaaatgtgttccataccgttgtggccacagagcccataaaccagggggtttgatggttggcactcctacccaaactattgttgcagtggtgtttgttagaataaaccttgactattattctgtacaatttgcctttatcttgtactgccaattattgtgtagtggtcaaaaaaaaaaaaaaaaaaaaaaaaaaaaaag

SEQ ID NO: 50 - protein, 98 aa, Zea mays
IYVNPKQYHGILRRRQLRAKLEAQNKLVRARKSYLHESRHLHAMKRARGSGGRFLNTKQLQQSHTALTRSTTTSGTSSSGSTHLRLGGGAAAAGDRSV

SEQ ID NO: 51 - DNA, 1307 bp, Zea mays
ccacgcgtccgctgtctgtgtgcgagcgcaagagaaagggagtcagagagagagagagagggaggagaccttgcagaggagcgaagcaagcaaggtgggaaagaggcagcagcaagggcggcgggctgccggaaggggaacatgctccctcctcatctcacagtacgaactgaaaaacaagagtaaagaatttccgtgagatgagacagaatggcgcggtgatgattcagtttggccatcagatgcctgattacgactccccggctacccagtcaaccagtgagacgagccatcaagaagcgtctggaatgagcgaagggagcctcaacgagcataataatgaccattcaggcaaccttgatgggtactcgaagagtgacgaaaacaagatgatgtcagcgttatccctgggcaatccggaaacagcttacgcacataatccgaagcctgaccgtactcagtccttcgccatatcatacccatatgccgatccatactacggtggcgcggtggcagcagcttatggcccgcatgctatcatgcaccctcagctggttggcatggttccgtcctctcgagtgccactgccgatcgagccagccgctgaagagcccatctatgtcaacgcgaagcagtaccacgctattctccggaggagacagctccgtgcaaagctagaggcggaaaacaagctcgtgaaaagccgcaagccgtacctccacgagtctcggcacctgcacgcgatgaagagagctcggggaacaggcgggcggttcctgaacacgaagcagcagccggagtcccccggcagcggcggctcctcggacgcgcaacgcgtgcccgcgaccgcgagcggcggcctgttcacgaagcatgagcacagcctgccgcccggcggtcgccaccactatcacgcgagagggggcggtgagtagggagccccgacactggcaactcatccttggcttatcagcgattcgactcggctctccctcgtctgaaactgaactctctgcaactactgtaactgtaactaaactgggtgtgcccggattggcggtcgttctgttctactactagtacctgctacgcgtcgttgggttgggtctggactagagagcgtgctggttctttgatgaacttggctggacttgagggtgttgactagcgcgaagctgagttccatgtaaaacttttgcttcaagaccgatgactggcggcataataagtagcagtaatacccaaaaaaaaaaaaaaaaaaaaaaaaaaaaaaaaaaaaaaaaaaaaaaaaaaaaaaaaaaaaaaag

SEQ ID NO: 52 - protein, 244 aa, Zea mays; identical to SEQ ID NO: 28

SEQ ID NO: 53 - DNA, 816 bp, Zea mays
ccacgcgtccgcgcagaacaagatggtgaaaggccggaagccataccttcatgagtctcgacaccgtcatgccatgaagcgggcccgtggctcaggagggcggttcctcaacacaaagcagcagccccaggagcagaaccagcagtaccaggcgtcgagtggttcaatgtgctcaaagaccattggcaacagcgtaatctcccaaagtggccccatttgcacgccctcttctgacgctgcaggtgcttcagcagccagccaggaccgcggctgcttgccctcggtgggcttccgccccacagccaacttcagtgagcaaggtggaggcggctcgaagctggtcgtgaacggcatgcagcagcgtgtttccaccataaggtgaagagaagtgggcacgacaccattcccaggcgcgcactgcctgtggcaactcatccttggcttttgaaactatggatatgcaatggacatgtagcttcgagttcctcagaataaccaaacgtgaagaatatgcaaagtccttttgagatttgctgtagctgaaagaactgtggttaggttatgagtttcttcctggagactgatccatacatgacatgctacctcgtgctgagtttctgaggtgaagccatcgaaacatgaccgtgtggttcagtacccttgctgccttcagtgtctgataagctagctctccagtttgcagtttctctgaattccagcatgtctagtctctgcttatcttttgcatgtaacgtgatggtgacttagcatacacatctattcatccatctatgttctcaaaaaaaaaaaaaaaag

SEQ ID NO: 54 - protein, 78 aa, Zea mays
HASAQNKMVKGRKPYLHESRHRHAMKRARGSGGRFLNTKQQPQEQNQQYQASSGSMCSKTIGNSVISQSGPICTPSSD

SEQ ID NO: 55 - DNA, 1630 bp, Argemone mexicana
gcacgagtgcagacaagagtagattttatgaaatcgatggctctaaaatctctaaaaagtgagtgttctagggtttattcttttactgttctcaataacaattggataggagattgattgtttttgaagtaatttgaaccatgcactcgattcctgggaatgtgaatgcaacagaatcggacgtgcaacgtactccgcaatcaactatttgttctcaaccttggtggtgtggtactgtgtataacactggttcgtcagctgagttgggagaaagcacaataaaatcgtcttcaatggaacagccagacggtggaatgggtattgataccagagaatcacatggtgatggtggtcctaatgagggggatggtattacgagaaagatgcacaccaccatggcctcccaatctgggccagatggaaactatggacatgaacatgggaatctgcagcatgctgcatctgcaatgccccaaactagtggtgaatacgtcataccgcgtccacagtttgagcttgttggtcactcagttgcatgtgcaacgtacccgtattctgatatgtattatactggaatgatggctgctttgggaactcaggctcaggtacatcctcatttatttggtgtacaacacaccagaatgcctttacctcttgaaatggctgaagagcctgtctatgtaaatgcgaagcaatatcatggaattctgagacgaaggcagtcgcgtgcaaaggctgagctagaaaggaaactgattaaatctagaaagccgtaccttcatgaatctcggcaccaacatgctatgagaagggcaaggggttgtggaggccgttttctcaacacaaaaaaactcgaaaacgggtcatctaagcatacaactgagaacagcatggcttctgattgtaatggtaaccggaactccccaagtggtcaacaagaaatagaaggttccaacgtgcaggaatcacattcctactttaacagcaatgataaaagctgctaccaacataatcagggtctgcagttatcaagtttccatccattatctggtgagagaggagaggaaggagactgttcaggcctgcagcgaggaagcatctcggtgaaccaggcccagaacagggccctcaccatccagtgaacctctgagtaggggaatagggtttctccatcgtcagtatcccgtttgctgttactgctctgggacttcaaataccatgtaagcaacggaaagcagcaatggcgctgaagggatggacgcaaaccagaaacggattccccccaaggtaattggtgtttctcaggcaattcattcttggcttggttcttgtgtttgatggggaaagaggagtgtaggttctatttggttctgtggtgtccttacaacttctctactctttccctcttgttttttttttatcccttgttgtacaaaggaaatgatagtggctgttttagaatctaagtagtgagaagaaaccaaaccaaacccttttttcttcaaaatttcgtgaaacattgttttaactctgtagacatcaaaattttctaggcatgtaaaatattcgtctttttttttttccatgaaaaaaaaaaaaaaaaaaaaaaaaaaaaaaaaaaaaaaaaaaa

SEQ ID NO: 56 - protein, 333 aa, Argemone mexicana
MHSIPGNVNATESDVQRTPQSTICSQPWWCGTVYNTGSSAELGESTIKSSSMEQPDGGMGIDTRESHGDGGPNEGDGITRKMHTTMASQSGPDGNYGHEHGNLQHAASAMPQTSGEYVIPRPQFELVGHSVACATYPYSDMYYTGMMAALGTQAQVHPHLFGVQHTRMPLPLEMAEEPVYVNAKQYHGILRRRQSRAKAELERKLIKSRKPYLHESRHQHAMRRARGCGGRFLNTKKLENGSSKHTTENSMASDCNGNRNSPSGQQEIEGSNVQESHSYFNSNDKSCYQHNQGLQLSSFHPLSGERGEEGDCSGLQRGSISVNQAQNRALTIQ

SEQ ID NO: 57 - DNA, 1565 bp, Argemone mexicana
caagaaagaaaagagagaagaaagaaaattttttgaaggtgggtttgaacagaggagacatgaccagatctatcccaacatctcttctccttatttctctcactttaccaaatcccaaagtaaattcactccagaagcgcgtaatataggttttcaaaaacagttctgaggattttagattgttttcatcttggtttggaatttacatagtgaagttaagtgaacaagaatgcaagacaagtcaatttcacatagtgttgttagttgtccaatttggtggacttctactggatcccaagttccacagagttgtttatcaaagagtttaagcgtaaccttcgactcttctcgtcaagattgcggtagtttgaagcagctaggttttcaacttcaagatcaggattcatcctcgactcaatcaactggtcagtcgcatcatgaagtgggaaatatgtctggaagcaaccctactgggcaatgcatttcagctcagtgcgaaaaagttacttacgggaaacaaggagatgttcaaacgaaatcaattctatcacttggagctccagaagttgttctccctcaacaagttgattataaccaccactcagtggctcgtataccctatcattacgttgatccgtattacggtggcataatggcgtcttatggaccacaggctattattcacccacaaatgatgggtataacacctgcacgagtcccattgcctcttgatcttgcagaaaatgagcccatgtatgttaatgcaaaacagtaccgagcaattcttagacggaggcagtcccgtgctaagcttgaggctcaaaataaacttatcaaagatcgcaagccttatctacatgaatctcggcatcttcatgcattgaagagggctaggggatctggtggacgttttctcaacacgaagcagctgcaagagttgaaacaaaacaactctaatggccaaaatacctccgagtcagcttatctacagttgggaggaaatctatctgaatcagaatttggcaacggtggcggtgcttccaccacatcctgctctgacatcactacagcctcaaacagcgaccacattttccgtcaacagaatctcaggtttgcgggttacactcacatgggtgggaccatgcaagatggaggtggagggggcattatgagtaacgggtctcaccaccgtgttcccgttacacagtaaaaaacatggggagaaaaacaactttgtcagccttttcgattttggtgtgaagaatggtgtgtactctcagggtggaactggagaactggctggcttgtgttgtttacccatgggcaaatcatccttggctttgttaccttttatttatcactatactttttatatgatgtttcttgctatatatgttttgttgattttaacttccatagatggacaatgatgaatttctgatactggattgtccttgaaactcttcgcttttattatatattttgcgaaaaaaaaaaaaaaaaaaaaaaaaaaaaaaaaaaaaaaaaaaaaaaaaaaaaaaaaaaaaaaaaaaaaaaaaaaaaaa

SEQ ID NO: 58 - protein, 326 aa, Argemone mexicana
MQDKSISHSVVSCPIWWTSTGSQVPQSCLSKSLSVTFDSSRQDCGSLKQLGFQLQDQDSSSTQSTGQSHHEVGNMSGSNPTGQCISAQCEKVTYGKQGDVQTKSILSLGAPEVVLPQQVDYNHHSVARIPYHYVDPYYGGIMASYGPQAIIHPQMMGITPARVPLPLDLAENEPMYVNAKQYRAILRRRQSRAKLEAQNKLIKDRKPYLHESRHLHALKRARGSGGRFLNTKQLQELKQNNSNGQNTSESAYLQLGGNLSESEFGNGGGASTTSCSDITTASNSDHIFRQQNLRFAGYTHMGGTMQDGGGGGIMSNGSHHRVPVTQ

SEQ ID NO: 59 - DNA, 1187 bp, Oryza sativa
gcacgaggcagaggagagaagcaaggtgagaagtgaggaggcagcaagggaggaggtttgccggagaggggacatgctccctcctcatctcacagaaaatggcacagtaatgattcagtttggtcataaaatgcctgactacgagtcatcagctacccaatcaactagtggatctcctcgtgaagtgtctggaatgagcgaaggaagcctcaatgagcagaatgatcaatctggtaatcttgatggttacacgaagagtgatgaaggtaagatgatgtcagctttatctctgggcaaatcagaaactgtgtatgcacattcggaacctgaccgtagccaaccctttggcatatcatatccatatgctgattcgttctatggtggtgctgtagcgacttatggcacacatgctattatgcatccccagattgtgggcgtgatgtcatcctcccgagtcccgctaccaatagaaccagccaccgaagagcctatttatgtaaatgcaaagcaataccatgcgattctccgaaggagacagctccgtgcaaagttagaggctgaaaacaagctggtgaaaaaccgcaagccgtacctccatgaatcccggcatcaacacgcgatgaagagagctcggggaacaggggggagattcctcaacacaaagcagcagcctgaagcttcagatggtggcaccccaaggctcgtctctgcaaacggcgttgtgttctcaaagcacgagcacagcttgtcgtccagtgatctccatcatcgtcgtgtgaaagagggcgcttgagatcctcgccgtttctgtcatggcaaatcatccttggcttatgtgtggtgcccagcaaaaaaaaatctgactgaacctgtgtgtaaactgatgggtatgggtgggttttgtgcaactgtaactagggtgcttgacatctgtgtctgttgttcctctgcctccttagtttggagacggtgcagctgcagctggtaccagtaatctgatcatgctagacttgtgacaaggacaaaactagcaccccgttatgtttcctggcttctgaatttggtggtcattcagtaagcaagcactcgacgtcagcgggagggggttgcttcgattgatctagttctttcgcgataaacttatttaattttgaacaaaggttggtttcaaaaaaaaaaaaaaaaaa

SEQ ID NO: 60 - protein, 239 aa, Oryza sativa
MLPPHLTENGTVMIQFGHKMPDYESSATQSTSGSPREVSGMSEGSLNEQNDQSGNLDGYTKSDEGKMMSALSLGKSETVYAHSEPDRSQPFGISYPYADSFYGGAVATYGTHAIMHPQIVGVMSSSRVPLPIEPATEEPIYVNAKQYHAILRRRQLRAKLEAENKLVKNRKPYLHESRHQHAMKRARGTGGRFLNTKQQPEASDGGTPRLVSANGVVFSKHEHSLSSSDLHHRRVKEGA

SEQ ID NO: 61 - DNA, 1442 bp, Oryza sativa
gcacgagtacagcgctccgcattagggctcgcctctcgttggctagagcgcgagagccagtagccgcagctgcagcaagcagcagcagcagcgaagagcctgagccccagaggaggcgtgcaccgcctccgattggccggcctctcggagagagagagagagagagagatcgatcgagtcctattggccgccgcctccgcgccctggctgctcactggtgagcgagcatggagtcgaggccggggggaaccaacctcgtggagccgagggggcagggcgcgctgccgtccggcataccgatccagcagccgtggtggacgacctccgccggggtcggggcggtgtcgcccgccgtcgtggcgccggggagcggtgcggggatcagcctgtcgggcagggatggcggcggcgacgacgcggcagaggagagcagcgatgactcacgaagatcaggggagaccaaagatggaagcactgatcaagaaaagcatcatgcaacatcgcagatgactgctttggcatcagactatttaacaccattttcacagctggaactaaaccaaccaattgcttcggcagcataccagtaccctgactcttactatatgggcatggttggtccctatggacctcaagctatgtccgcacagactcatttccagctacctggattaactcactctcgtatgccgttgcctcttgaaatatctgaggagcctgtttatgtaaatgctaagcaatatcatggaattttaagacggaggcagtcacgtgcgaaggctgaacttgagaaaaaagttgttaaatcaagaaagccctatcttcatgagtctcgtcatcaacatgctatgcgaagggcaagaggaacgggtggacgcttcctgaacacaaagaaaaatgaagatggtgctcccagtgagaaagccgaaccaaacaaaggagagcagaactccgggtatcgccggatccctcctgacttacagctcctacagaaggaaacatgaagtagcggctcgaaacctagaacagtggcttctgtccaccggcattcactcttgaggtgattcttgctccagaattgtgctccatctttcaaatgatcttcatcgagcaaagtaattatatgtacattcctctgaatgatctatgcaccaattgttgatcctggcagggtaataatctggatgtattgagtccatcacagtgcgaatgtcacgggtagatctgctgttttcaggcaattcattcttggctttctatcccacccgttgttgttgcaagttaagctagcagtacttgtctcagtgtccgtgagacgtttgtgtaagattaggttaaactagaagttgtaatgctgtattaagtgtttgtatttctaatatgaaccgtaacaaggccagagcagaactcgttatacatacaaaaaaaaaaaaaaaaaaaaa

SEQ ID NO: 62 - protein, 258 aa, Oryza sativa
MESRPGGTNLVEPRGQGALPSGIPIQQPWWTTSAGVGAVSPAVVAPGSGAGISLSGRDGGGDDAAEESSDDSRRSGETKDGSTDQEKHHATSQMTALASDYLTPFSQLELNQPIASAAYQYPDSYYMGMVGPYGPQAMSAQTHFQLPGLTHSRMPLPLEISEEPVYVNAKQYHGILRRRQSRAKAELEKKVVKSRKPYLHESRHQHAMRRARGTGGRFLNTKKNEDGAPSEKAEPNKGEQNSGYRRIPPDLQLLQKET

SEQ ID NO: 63 - DNA, 423 bp, Oryza sativa
  unsure (223): n = A, C, G, or T
  unsure (330): n = A, C, G, or T
  unsure (369): n = A, C, G, or T
  unsure (389): n = A, C, G, or T
  unsure (402): n = A, C, G, or T
cattggttctaatcttgacagagtttaaggttggcactttctgtcagaagttaagttaggacttccacaaaattataccatctctgggtgttcttataggtgtttctcactatcaggaatgtacagttcttgcagctgtcaagttctttgtacctatgtttctgtatcttctaaagattttgattcgtctgcactgtgcagccatatctccatgagtcacggnatcaacatgccctgaaaagggctaggggagctggaggccgatttcttaattcaaaatcggatgacaaggaaagagcattctgattccaagttccaagagataaacangatggagttgcacccccgtgataatgggcaaacgtctanctctccgtcttcaaaggggnggatcatcagctnaacaaaataaagaagtcaaaa

SEQ ID NO: 64 - protein, 34 aa, Oryza sativa
  UNSURE (9): Xaa = any amino acid
QPYLHESRXQHALKRARGAGGRFLNSKSDDKERA

SEQ ID NO: 65 - DNA, 479 bp, Oryza sativa
ctcttctcatctcatctccctctcctctcctctcgccgtcgccgtcgccgtcgccgccgctcgccgccggcggggatagagttcgccgggatcgcctcgccgggagagttccctcaccatcccgcacctccgctcgcctggcctcttcctcccggaagtgtggtgtgctgcaagctcctgtctctcctacaaggtttcaaaaccaaaatatgcctgaagcacacggaaagctggggtgattaacgtctgtttcttttgactacaatcatcctgattctgcttctgtctgcaaaaacaaccaagccatgacgtctgtagttcatgatgtttcaggcaaccatggagctgatgagcggcaaaaacagcaaaggcaaggtgaacctgaggaccaagcaagaagcctcagttactagtacagatagccatacaatggtaagcaacaccttcaacagattatgcgacaacctatgcccatcacg

SEQ ID NO: 66 - protein, 35 aa, Oryza sativa
MTSVVHDVSGNHGADERQKQQRQGEPEDQARSLSY

SEQ ID NO: 67 - DNA, 1107 bp, Oryza sativa
gcacgagcaattatccttgtattgaccaatgctatggtcttatgaccacctacgcgatgaaatcaatgagtggcgggcgaatgctactgccgctgaacgcgccagccgatgcgccgatctatgtcaacgcgaagcagtacgaaggcatcctccgccgtcgccgtgcccgcgccaaggcccagagggagaacaggctggtcaaaggcaggaagccctacctccacgagtcgcgccaccgccacgccatgcgccgggccagaggctccggcggccgcttcctcaacaccaagaaagaagccaccgccgccggatgcggcggcagcagcaagacgcccctcgcgtccctcgtcagccccgccgacgtagcccatcgtccaggctccggcggccgcgcgtccagcctctccggctccgacgtgtcgtcgccgggaggcgtcatgtacgaccaccaccgccacgacgacgccgacgcggcggaccactacaacagcatcgaccaccacctccgcacgccgttcttcaccccgctcccgatcatcatggacagcggcggcggcggcggcgaccacgcctcacactccgccgccgccgtcgccgcccccttcaggtgggcgacggcggccggcgacggctgctgcgagctcctcaaggcgtgacagccttgaggcggggatctccaggcgtgcccagagctgctgctgatcgatcaccatcagctttggctgcctgtaggcaaatcattcttggctctttacttgcattggggttcttgcaagcaactctcctcgtcacctaccaaaactgtccctgaaacttctctagtgctggggtctcgatcagggatgatgatgtgatggaggagaggcttacccatatgcctgtaaattatggttagtgttctgattaagcaactagtagtacttggtaattactggctatgaattagtagtatggactctggtgtcaggttgctctttgtctgaataaactggagtcgtttgaagctttgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 68 - protein, 217 aa, Oryza sativa
TSNYPCIDQCYGLMTTYAMKSMSGGRMLLPLNAPADAPIYVNAKQYEGILRRRRARAKAQRENRLVKGRKPYLHESRHRHAMRRARGSGGRFLNTKKEATAAGCGGSSKTPLASLVSPADVAHRPGSGGRASSLSGSDVSSPGGVMYDHHRHDDADAADHYNSIDHHLRTPFFTPLPIIMDSGGGGGDHASHSAAAVAAPFRWATAAGDGCCELLKA

SEQ ID NO: 69 - DNA, 977 bp, Oryza sativa
gcacgaggcaaactctaggatgccattgcctgttgatccttctgtagaagagcccatatttgtcaatgcaaagcaatacaatgcgatccttagaagaaggcaaacgcgtgcaaaattggaggcccaaaataaggcggtgaaaggtcggaagccttacctccatgaatctcgacatcatcatgctatgaagcgagcccgtggatcaggtggtcggttccttaccaaaaaggagctgctggaacagcagcagcagcagcagcagcagaagccaccaccggcatcagctcagtctccaacaggtagagccagaacgagcggcggtgccgttgtccttggcaagaacctgtgcccagagaacagcacatcctgctcgccatcgacaccgacaggctccgagatctccagcatctcatttgggggcggcatgctggctcaccaagagcacatcagcttcgcatccgctgatcgccaccccacaatgaaccagaaccaccgtgtccccgtcatgaggtgaaaacctcgggatcgcgggacacgggcggttctggtttaccctcactggcgcactccggtgtgcccgtggcaattcatccttggcttatgaagtatctacctgataatagtctgctgtcagtttatatgcaatgcaacctctgtcagataaactcttatagtttgttttattgtaagctatgactgaacgaactgtcgagcagatggctaatttgtatgttgtgggtacagaaatcctgaagcttttgatgtacctaattgccttttgcttatactcttggtgtatacccattaccaagttgccttaaaaaccctccaattatgtaatcagtcatggttttatagaaccttgccacatgtaatcaatcacctgtttttgtaaattgatctataaacgctataggctgctgtgttatctgcatttaaaaaaaaaaaaaaaaaaaaaaaaaaaaaaaaaaaaaaaa

SEQ ID NO: 70 - protein, 168 aa, Oryza sativa
ANSRMPLPVDPSVEEPIFVNAKQYNAILRRRQTRAKLEAQNKAVKGRKPYLHESRHHHAMKRARGSGGRFLTKKELLEQQQQQQQQKPPPASAQSPTGRARTSGGAVVLGKNLCPENSTSCSPSTPTGSEISSISFGGGMLAHQEHISFASADRHPTMNQNHRVPVMR

SEQ ID NO: 71 - DNA, 465 bp, Oryza sativa
  unsure (280): n = A, C, G, or T
  unsure (325): n = A, C, G, or T
  unsure (349): n = A, C, G, or T
  unsure (358): n = A, C, G, or T
  unsure (368): n = A, C, G, or T
  unsure (379): n = A, C, G, or T
  unsure (385): n = A, C, G, or T
  unsure (425): n = A, C, G, or T
  unsure (429)..(430): n = A, C, G, or T
  unsure (436): n = A, C, G, or T
  unsure (459): n = A, C, G, or T
  unsure (464): n = A, C, G, or T
cttacagcagccttaccttcacgaatctcggcatcgccatgcaatgaagagggctaggggcactggtgggcgattcctgaataccaagcagctccagctgcagcaacagtctcacactacctccaccaagaccaccacagacagccaaaattcttcaggttcaagtcatctacggctaggtggtggcgcaatcggagatcaaactccatttccgttcaaagcaatggattcacaagctaacatcaagagagctgcagcttctgcttccaccttcactgtnacttctgcgggacaaaaagacgacgccttcttcgaccgccatggncaacatctcaataacttctccggncattttggncaagcaagcncacaaaggggngtcggnaagcatgcataaccggtcaaaagcaagagggttcctgctnatgnngatganatgaaagagcagcttggaaatcnaacant

SEQ ID NO: 72 - protein, 131 aa, Oryza sativa
  UNSURE (123): Xaa = any amino acid
LQQPYLHESRHRHAMKRARGTGGRFLNTKQLQLQQQSHTTSTKTTTDSQNSSGSSHLRLGGGAIGDQTPFPFKAMDSQANIKRAAASASTFTVTSAGQKDDAFFDRHGQHLNNFSGHFGQASXQRGVGKHA

SEQ ID NO: 73 - DNA, 1482 bp, Glycine max
tttctgttcttctctggggatctgaagacatgcagtccaagtctgaaactgcaaatcgactgagatcagatcctcattcctttcaacctggcagtgtttattctgagccttggtggcgtggtattgggtacaatcctgtggcccaaacaatggctggggcaaatgcatccaattcatcgtctcttgaatgccctaatggtgattctgaatccaatgaagaaggtcaatctttgtccaatagcgggatgaatgaggaagatgatgatgccactaaggattcacagcctgctgttcctaatggaacaggaaattatgggcaagaacagcaagggatgcagcatactgcatcatctgcaccctccatgcgtgaagaatgccttactcagacaccacagctggaacttgtcggtcattcaattgcatgtgctacaaatccttatcaggatccgtattatgggggcatgatggcagcttatggtcaccaacagttgggatatgctccttttataggaatgcctcatgccagaatgcctttgccccttgagatggctcaagaacctgtgtatgtgaatgccaaacagtaccaaggaattctgaggcgaagacaggctcgtgctaaagcagagcttgaaaggaagctcataaaatctagaaagccatatcttcatgaatctaggcatcagcatgctatgagaagggcaaggggtactggaggacgatttgcaaagaaaactgacggtgagggctcaaaccactcaggcaaggaaaaggataatggtactgattctgtcctatcatcacaatcaattagttcatctggttctgaacctttacattctgactctgccgaaacctggaattctcctaacatgcaacaagatgcaagagcatcaaaagtgcacaacaggttcaaagcaccctgttaccaaaatggcagtggctcctaccataatcataatggattgcaatcttcagtgtaccattcatcctcaggtgaaagactggaggaaagggattgttcgggtcagcaactgaaccacaattgatggggggttagaggccgaggttggtttgtatccaagtgacatatttggtgaataccttggttatctgtaaacactcttggcaatatatatgccaagcggcaaatcattcttggctttgttcttgtgtttgtggtgttaatgatactatggggggggtggggggggggggaatgattggtatttgagatttctgttgaagtcagtcaatcaatccttcgttcttttctcatttttgcattttgtaaagttttatagtggttaggatggtcacttcagaagattatggagtatggtgagaaacaaactcttgatgtgccaacactcgtttgactggtttatctttgtgtagttcaaccggttgttaatgttaacataagacatcataggataatgaacatgctgttagttacattacatcaaaaaaaaaaaaaaaaaa

SEQ ID NO: 74 - protein, 338 aa, Glycine max
MQSKSETANRLRSDPHSFQPGSVYSEPWWRGIGYNPVAQTMAGANASNSSSLECPNGDSESNEEGQSLSNSGMNEEDDDATKDSQPAVPNGTGNYGQEQQGMQHTASSAPSMREECLTQTPQLELVGHSIACATNPYQDPYYGGMMAAYGHQQLGYAPFIGMPHARMPLPLEMAQEPVYVNAKQYQGILRRRQARAKAELERKLIKSRKPYLHESRHQHAMRRARGTGGRFAKKTDGEGSNHSGKEKDNGTDSVLSSQSISSSGSEPLHSDSAETWNSPNMQQDARASKVHNRFKAPCYQNGSGSYHNHNGLQSSVYHSSSGERLEERDCSGQQLNHN

SEQ ID NO: 75 - DNA, 1385 bp, Glycine max
gcacgaggggattttgagtggaggggaaaagttgtgctaagatgccggggaaagctgacactgatgattggcgagtagagcggggtgagcagattcagtttcagtcttccatttactctcatcatcagccttggtggtgtggagtgggggaaaatgcctctaaatcatcttcagctgatcagttaaatggttcaatcgtgaatggtatcacgcggtctgagaccaatgataagtcaggtgaaggtgttgccaaagaataccaaaacatcaaacatgccgtgttgtcaaccccatttaccatggacaaacatcttgctccaaatccccagatggaacttgttggtcattcagttgttttaacatctccttattcagatgcacagcatggtcaaatcttgactacttacgggcaacaagttatgataaaccctcaattgtacggaatgtatcatgctagaatgcctttgccacctgaaatggaagaggagcctgtttatgtcaatgcaaagcagtatcatggtattttgaggcgaagacagtcacgtgctaaggctgagcttgaaaagaaagtaatcaaaaacaggaagccatacctccatgaatcccgtcaccttcatgccatgagaagggctagaggcaatggtggtcgctttctcaacaaaaagaagctcgaaaattacaattctgatgccacttcagacattgggcaaaatactggtgcaaacccctcaacaaactcacctaacactcaacatttgttcaccaacaatgagaatctaggctcatcaaatgcgtcacaagccacggttcaggacatgcacagagtggagagtttcaatattggttaccataatggaaatggtcttgcagaactgtaccattcacaagcaaatggaaaaaaggagggaaactgctttggtaaagagagggaccctaataatggggctttcaaatgacacttcgcccagccatacagcaacagttaggtgaagatgaagggtttttatctcatccaacttgtgatgctgtattgaaggcaattcattcttggcttagttaagtggtgagaccagtgacatggagtacactctgccttgtttggtctctccccttgcatttgtttctctttacaagtccatatgtaaaaatggataacggaaagaaaaagaaaaatcacttttgtttgagaacttttttaagtttgtttttaactgtgtgaaggtttcataaaattgtggactgacttgtgtgacatatgctccacaaaaccttaaaactttcgtctattttgtccaaaaaaaaaaaaaaaaaaaaaaaaaaaaaaaaaaaaaaagggaaaaaaaaaaaaaaaaaaaaaaaaaaaaaaaaaaaaaaaaaaaaaaaaa

SEQ ID NO: 76 - protein, 304 aa, Glycine max
MPGKADTDDWRVERGEQIQFQSSIYSHHQPWWCGVGENASKSSSADQLNGSIVNGITRSETNDKSGEGVAKEYQNIKHAVLSTPFTMDKHLAPNPQMELVGHSVVLTSPYSDAQHGQILTTYGQQVMINPQLYGMYHARMPLPPEMEEEPVYVNAKQYHGILRRRQSRAKAELEKKVIKNRKPYLHESRHLHAMRRARGNGGRFLNKKKLENYNSDATSDIGQNTGANPSTNSPNTQHLFTNNENLGSSNASQATVQDMHRVESFNIGYHNGNGLAELYHSQANGKKEGNCFGKERDPNNGAFK

SEQ ID NO: 77 - DNA, 1401 bp, Glycine max
gaagtctttatgtgacctgggtggaatgattctgtgtctgcatgtgtgaattctggcaagggaactagggatctgaagataagatatgcaatctaaatctgaaactgcaaatcaactgaggtctgatccacattcctttacacctaacaatgcttattctgaaccctggtggcgaggtattcagtacaatcctgtcccccaagcaatgttaggagtgaatgcatctaattcatcttcacttgaacgccctaatggtgattcggaatccagtgaagaggatgatgatgccactaaagaatcacaacccactgctcctaatcaatcaggaaattatggacaggaccaccaagcgatgcaacattcttcatcatctgcacctttggtacgtgatgattgccttacacaggctccacaagtggaacttgttggccactcaattggatacactccttttataggaatgccccatgccagaatggctttgccccttgagatggctcaagagcctgtttatgtgaatgccaaacaataccaaggaattctgagacgaagacaggctcgtgctaaagcagagcttgaaaagaaattaataaaagtcagaaagccatatcttcatgaatcccggcatcagcatgctataagaagagcacgaggtaatggagggcgttttgcaaagaaaactgaagttgaggcttcaaaccacatgaacaaggaaaaggatatgggtactggccaggtcccattgtcacggtcaattagttcatctggttttggatcactaccctctgactctgctgagacctggaattctcctagtgtgcaacaagatgcaagaggatctcaagtgcatgagagatttgaagaacgcaactatgcaaatgttttgcagtcatcatctactttttgtttgcactcgggtgaaagagtggaggaaggggactgttcaggtcaacaacggggaagcatcttgtcagagcacacctcacagaggcgtcttgctattcagtaaaccactgcatgtgttgatgctgaggttggtatatataattgagtgaactagtaggttgagtaccttggctatctatctgtaaacattggcaatttgcatgcatgtcaagcggcaaatcattcttggctgggtttcagctgttcatgatatggggagaagaatgattgattgggccatcatacttgtgttgttgaagtctaccagtccttcattatatcctctttttcattttttctgtttttgtacagagatagtagttagcaaagtcaagccaacggattagaagacttgatgaaacaaactactgactcactttcctctggcggctttattttatgttactcaccggttattaatgcttaatatgagacatcatatgagagatttgctgc

SEQ ID NO: 78 - protein, 307 aa, Glycine max
MQSKSETANQLRSDPHSFTPNNAYSEPWWRGIQYNPVPQAMLGVNASNSSSLERPNGDSESSEEDDDATKESQPTAPNQSGNYGQDHQAMQHSSSSAPLVRDDCLTQAPQVELVGHSIGYTPFIGMPHARMALPLEMAQEPVYVNAKQYQGILRRRQARAKAELEKKLIKVRKPYLHESRHQHAIRRARGNGGRFAKKTEVEASNHMNKEKDMGTGQVPLSRSISSSGFGSLPSDSAETWNSPSVQQDARGSQVHERFEERNYANVLQSSSTFCLHSGERVEEGDCSGQQRGSILSEHTSQRRLAIQ

SEQ ID NO: 79 - DNA, 1241 bp, Glycine max
gcacgaggtcctaagttgtaagaaacactctcttctcctttctcactattgttctgttactgttttttgcagcaacacttcagttcaattaacgaactacaccactttctttctcttcttcgactgctctgtaaccgaaaacctccctttcccagtttcgaatcttttgtttctgcctttggttactgtttttccgagccatgctattcattattgtccttcgaatcggattgattgggacactgtattgcatgtaaatcaggaaatcatgacttctactcatgacctctcagataatgaagctgatgaccagcagcagtcggaatcacaaatggagcctttatctgcaaatggaatttcttatgcaggtattgctactcagaatgttcagtatgcaacaccttcacagcttggaactgggcatgctgtggtaccgcccacttacccatatccagatccatactacagaagtatctttgctccctatgatgcacaaacttatcccccacaaccctatggtggaaatccaatggtccaccttcagttaatgggaattcaacaagcaggtgttcctttgccaactgatacagttgaggagcctgtgtttgtcaatgcaaaacagtatcatggtatattaagacgcagacagtcccgtgctaaagctgaatcagaaaaaaaggctgcaaggaatcggaagccatacttgcatgaatctcgacatttgcatgcactgagaagagcaagaggatgtggaggtcggtttttgaattcaaagaaagatgagaatcaacaggatgaggttgcatcaactgacgaatcacagtccactatcaatctcaattctgataaaaatgagcttgcaccatcagatagaacatcctaaaactacagaaatggtgatgctgtagattgcagggatctgttgtgtatatctatattgggagatgaatctccaaccaacagtatcctcagatatctccctattattcattctgtcgtacaacgccataggtataagtataggttgtgtagtaggtatgttaggaggttgcaaaataaaacaagtaaaatgtaaattgaagtgattcaactaagtctatccccaatgtggtcctttcttgcctttttaggtatttttattgtgtgggcttttctttgtattatttggtgcctctgagggaaagagaagagattatccgaaaaaaaaaaaaaaaaaaaaaaaaaaaaaaaaaaaaaaaaaa

SEQ ID NO: 80 - protein, 204 aa, Glycine max
MTSTHDLSDNEADDQQQSESQMEPLSANGISYAGIATQNVQYATPSQLGTGHAVVPPTYPYPDPYYRSIFAPYDAQTYPPQPYGGNPMVHLQLMGIQQAGVPLPTDTVEEPVFVNAKQYHGILRRRQSRAKAESEKKAARNRKPYLHESRHLHALRRARGCGGRFLNSKKDENQQDEVASTDESQSTINLNSDKNELAPSDRTS

SEQ ID NO: 81 - DNA, 1716 bp, Glycine max
gcacgaggtacgtaccgacatgactccaacctgatggggttaaacactgcttctgcgtaggattcgatgccgctactccttcttcagtttctacaactgagtttcatatctcctttctattgatgtttatgctgaagactgaataaaagtctgagaaagctgcttactacaaaccaacaagattaactaagaaatcatcttttgggacgatgcaaactgtttatcttaaagagcacgaaggaaatgcgcacaattttgtgggcacgttgtcttctgcagcttcagcaccctggtggagtgcttttggatctcaatctgttcatcagggagagtcttgtggccaagtgaaacccttttcattggagctgccaaactgcatagaccaacttgctgccactaagccactagcaagaggagctgaccaagtgttgggtaaagggcacataactcagtttacaatctttccagatgattgtaaaatgtcagatgatgcgcaaaagcttcagacaaccatgtcactgcagtcatcgcttactgatccacagtctcgttttgagatagggtttagtctgcccacgatatgtgcaaaatatccttatacggatcaattttatggactcttctcagcttatgcacctcaaatttcgggacgtataatgctgccacttaacatgacatctgatgatgaaccaatttacgtaaatgctaagcagtaccatggaatcattagacgtcggcagtcccgtgccaaagctgtacttgatcacaaattgactaaacgtcgcaagccctatatgcacgaatcacgccatctccatgcaatgcggcgaccaagaggatgtgggggtcgcttcttgaacactaagaattctgttgacggaaatggtaaaattggaaatgaagtgcataaaactgttggtgaacaattgcagtctagtggctctcagagttctgaattccttcaatctgaggttggaacttttaattcatcaaaagagactaatggaagcagtccaaatatttctggttcagaggtgactagcatgtattcgcggggaggtcttgacagcttttctctcaatcatcttggatctgctgtccactcttttgcagacatgatagatggtgggcgcggtatgatcatacccaccaaatgggttgcagcagcaggtaactgctgcaaccttaaagtttgatttgcaaagaatcaagggtgggcttgctgtagcattgcaccaggcccatcctcgatgaggccagatgaagaagcttcgtttcagttgcgtgtgctgactgtgacaagtttcgctcggtaagatcgtcctcacatctggtctaggcaatccatccttggctcatactttggcaatccatccttggctcattgtaactgaaggcaactcatccttggcttgatgtacttgcagtaatttgtctttctgcacaggaatgttgttggcatggtacaaactaatgacttgatatcctgatgcagaagacaactatgtttctgtctttgtgtgaaaatgaaagcatgaaactctagttatgtgtgcttcgaataatgtctaaacgtggtgttgtattttgtatttctgacttcgaggaacaatgtattatagaaccttgttctgtggtctttgttagaaaaaataaagcattggtgtgtttttctccaaaaaaaaaaaaaaaaaaaaaaaaaaaaaaaaaaaaaag

SEQ ID NO: 82 - protein, 328 aa, Glycine max
MQTVYLKEHEGNAHNFVGTLSSAASAPWWSAFGSQSVHQGESCGQVKPFSLELPNCIDQLAATKPLARGADQVLGKGHITQFTIFPDDCKMSDDAQKLQTTMSLQSSLTDPQSRFEIGFSLPTICAKYPYTDQFYGLFSAYAPQISGRIMLPLNMTSDDEPIYVNAKQYHGIIRRRQSRAKAVLDHKLTKRRKPYMHESRHLHAMRRPRGCGGRFLNTKNSVDGNGKIGNEVHKTVGEQLQSSGSQSSEFLQSEVGTFNSSKETNGSSPNISGSEVTSMYSRGGLDSFSLNHLGSAVHSFADMIDGGRGMIIPTKWVAAAGNCCNLKV

SEQ ID NO: 83 - DNA, 1103 bp, Glycine max
gcacgaggaaatgaagaattagagggagtgagaggaggaagaagaagaagaagattccagaatccagagtgagaaacattaggcttatcagaggagacatgcccgagttgaaccgacaattctattactactctttgcttctttcttcatgcctcatcaaatcccaaaggatataattgaaggttttgggaactaaggctgcaatattgtatacattctactcaaggaatggctcatacttcttatccttgtggtgatccttattttggtagttcaatagttgcttatggaacacaggctattactcaacaaatggtgccccagatgctgggattagcatccaccagaattgcattaccagttgagcttgcagaagatgggcccatttatgtcaatgccaaacaataccatggtatactgagaaggcgacagtcacgagcaaagcttaaggctcaaaacaaactcatcaaaagtcgtaagccatatcttcatgagtctcggcaccgccacgcattgaaaagggttaggggaactggggggcgctttcttagtgccaaacagcttcaacagtttaatgcagaacttgtcaccgatgcccattcaggcccgggccctgtcaatgtttatcaaaagaaagatgcatctgaggcagaaagtcatccctcaagaactggaaaaaatgcatctatcacattcacagcaatctctggcttgacaagtatgtccggtaacagtgtcagtttcaggcggcctgagcacaacttcttggggaactctcctaatataggtggatcgtcgcaatgcagtgggggactcacctttggtggtggagctcggcaatgtacttcagttggccggtgagaggtggaaccaatcaaaatcaagttcactggtctggcaaatcatccttggcttagtcactttactttctgtgtttcatgtgttgttacggaaatgttgtcttttggaagactctgcattagcactcagacttttgctagtgctttcccatgtattttgaaagttgctcttgtttctgttgttgaactggaccagaaagtttgtgcttgaaaatttaactttttaaaaaaaaaaaaaaaaaa

SEQ ID NO: 84 - protein, 210 aa, Glycine max
MAHTSYPCGDPYFGSSIVAYGTQAITQQMVPQMLGLASTRIALPVELAEDGPIYVNAKQYHGILRRRQSRAKLKAQNKLIKSRKPYLHESRHRHALKRVRGTGGRFLSAKQLQQFNAELVTDAHSGPGPVNVYQKKDASEAESHPSRTGKNASITFTAISGLTSMSGNSVSFRRPEHNFLGNSPNIGGSSQCSGGLTFGGGARQCTSVGR

SEQ ID NO: 85 - DNA, 1128 bp, Glycine max
gcacgaggggtttgggtttcaagagaggagacatgcttaacttcaacccaacacttcaagtacttgcttcttcatacccttaccagatcccaaaggtcacgatctaattttaagtgattagtctgatgagcattttgaaggttacatgaagcaatttctctttttgaatcttcctgacaccgagatcaattgttcacaagttgattgcaatcactcaatggctcattcttcttatccctacggcgatccaattcttgcttatggaccacaagctattagtcatccccaaatggtaccccagatgctgggactagcatccaccagagtggcattaccacttgatcttgctgaagatggaccgatttatgtcaacgcgaaacaataccatggtatactgagaaggcgacagtcacgagcaaaacttgaggctcagaacaaacttatcaaaagtcgtaagccatatcttcatgagtctcggcaccgccatgctttgaatagggttaggggatctgggggtcgatttctgagtaccaaacagcttgcacagtctaatgcagaatttgtcaccggtgcacattctggttctgaccctaccaacatatatcagaaagaacatccattagaggtggaaagtcattcctcaaaagatggagataatgcatcattcataacaacctactccgaccggccatgtttatctggcaacaacctcaattttcggcagcaggagtgcatgtttctggggaattctgcaaacatgagtggagcaccacagtgcagtgggggactcacctttggcggagcaaagcaacgcacttcagttgtccggtgagagaagaaactgatcgaaaccgacttcaccggtcaggcaaatcatccttggcttagtcacttttgtctgtgtcttaatgtgttcgtactaaatgatcattttgagagactcttcagtctgcattagcactaataagacctttccaattgctttggcatgtattttaaagttgctattgtactggattctgaactggattggaatagtctgtgcatggaactagtatgtttgtgttagttactgttgaatttccttctttaaaaaaaaaaaaaaaaaaaaaaaaaaaaaaaaaaaaa

SEQ ID NO: 86 - protein, 228 aa, Glycine max
MKQFLFLNLPDTEINCSQVDCNHSMAHSSYPYGDPILAYGPQAISHPQMVPQMLGLASTRVALPLDLAEDGPIYVNAKQYHGILRRRQSRAKLEAQNKLIKSRKPYLHESRHRHALNRVRGSGGRFLSTKQLAQSNAEFVTGAHSGSDPTNIYQKEHPLEVESHSSKDGDNASFITTYSDRPCLSGNNLNFRQQECMFLGNSANMSGAPQCSGGLTFGGAKQRTSVVR

SEQ ID NO: 87 - DNA, 1286 bp, Helianthus sp.
gcacgagcttctagattttctctccgattcgtcgccccaaattttagggtttttacttttcgtcctctatactcgtagatcttggtgtaacagtattgcataagtttcatgtcctcttctgccatgcgagcgaattcatctgattcgtctcctccagaacagtcgttagacagggaatcacagtctgatgaagttcttagtgaggaagaagatgatgcaagcaaagaaacacaaaatgcttcgtcttttcgttcagataaaagttatcagcagcagggagtaccaaatatccttccaaataatggcgaaaccgtagggcaggtcccacaactagaacttgtcggtcacactattgcctgtgctccaaatccttattgtgatccatattatggtggaatgatggcagcttatggtcagccttttgttcatcctcagtttcttgagcaagcaaggatgcctttgccacttgaaatggcgcaagagcctgtttacgtgaatgccaaacaataccatgcgatattaaggcgaaggcaatcccgtgcaaaagcagagcttgagaagaaacttataaaagacagaaagccttatcttcatgaatcacggcatcagcatgctttgagaagggtaaggggcaccggtggtcgttttgcaaagaaaactgacgttaataagaacacaacaggttcgggttcaggttctgccatgtcatcatcccagtcggtgaattcaaaccgggtgcactcagaatctgccgagagcttggacacaccaaggggtggattggtaaattcacacaatactcgcacgtatcttgataacggaggttctttaggccagcagtggataaacatttcatctaaccaatcttcacagagggctgttgccatgaagtgatgtcgagtgtttaacaccctttgtgtctatccgtggcttctaagctggccggcaaatcattcttggctcatgttaatatgagggacaaacaggtaaatgtaccttttggtgtcctctttggttttactttcaggatttctttcttcggaactgatgttatgtacaaagtttgcttttggggatagaagaattggttgggttgggtttgtgtgttcttttctgaatgtttggtatatttggaggtgaagcatggagtttaagatgtgcttatgtctatcgtctaattgtaggggcatatagtgctccacagcctccagcacatgtgtaatgtcgtggctgttgaaaattggagcttcatatttactgttttgcaaaaaaaaaaaaaaaaaaaa

SEQ ID NO: 88 - protein, 261 aa, Helianthus sp.
MSSSAMRANSSDSSPPEQSLDRESQSDEVLSEEEDDASKETQNASSFRSDKSYQQQGVPNILPNNGETVGQVPQLELVGHTIACAPNPYCDPYYGGMMAAYGQPFVHPQFLEQARMPLPLEMAQEPVYVNAKQYHAILRRRQSRAKAELEKKLIKDRKPYLHESRHQHALRRVRGTGGRFAKKTDVNKNTTGSGSGSAMSSSQSVNSNRVHSESAESLDTPRGGLVNSHNTRTYLDNGGSLGQQWINISSNQSSQRAVAMK

SEQ ID NO: 89 - DNA, 1306 bp, Triticum aestivum
ggagaaacggaaacagagacagagggagaggagacttgcagaggagaggagagaagaggcggaacaagggaggagggaggggtcgccggaagggggacatgctccctccgcatctcacatctcgcagcttgaactgagagcaagagcagaagcccatgagatgagacgcaagcaaaatatgcaagaaaatggcacaatcatgattcagtttggtcagcaagtgcctaactgcgagtcctcagctagcgattctcctcaagaagtgtccggaatgagcgaagggagctttaatgagcagaatgatcaatctggtaatcgcgatggctatacgaagagtagtgatgaaggcaagatgatgtcggctttgtctctgggcaattcagaaatggcatacacaccgccaaaacctgaccgcactcatccctttgccatatcatacccatatgctgatccttactatggtggtgcagtggcagcctatggcgcacatgctattatgcacccccagatggtgggcatggtaccatcctctcgagtgccactaccgattgaaccagctgccgccgaagagcccatttatgtgaatgcgaagcaataccatgccattctccgaaggagacagctccgcgcaaaattagaggctgaaaataagctggtcaaaagccgtaagccgtacctgcatgagtcccggcaccagcacgcgatgaagcgggctcggggaacaggcgggcggttcctcaacgcaaaggagaagtctgaagcttcaggcggcggcaatgcatcagcgaggtctggccacgccggcgttcccccggatggcggcatgttctcgaagcacgaccacaccttaccatccggtgacttccattaccgcgcgagagggggcgcctagggtgggcacgcagttgccccctggcaaatcatccttggcttatgtgtgtggcgaatgaccgtcaactcggtccagtgatattgtaaaactgaatttagagtctgtgcaattgtgttacttgggggtttggtagacagcccttgtgtttggggaggggacgatgcagctgcagctgcagccggttctcttgttgtggtaggtttgtgtggcatggcaggtgctgctaagctggagcctgcttgaactgttttcctgtcactttgttgtttggggtaataatgaccatcttgtatgatattagtactgacttggagtaagtaataaccattcccggcgtgatgcatttgcgcccgtggtggtgtttctgttgaaaaaaaaaaaaaaaaaaaaaaaaaaaaaaaaaaaaaaaaaaaa

SEQ ID NO: 90 - protein, 243 aa, Triticum aestivum
MRRKQNMQENGTIMIQFGQQVPNCESSASDSPQEVSGMSEGSFNEQNDQSGNRDGYTKSSDEGKMMSALSLGNSEMAYTPPKPDRTHPFAISYPYADPYYGGAVAAYGAHAIMHPQMVGMVPSSRVPLPIEPAAAEEPIYVNAKQYHAILRRRQLRAKLEAENKLVKSRKPYLHESRHQHAMKRARGTGGRFLNAKEKSEASGGGNASARSGHAGVPPDGGMFSKHDHTLPSGDFHYRARGGA

SEQ ID NO: 91 - DNA, 1077 bp, Triticum aestivum
gcacgaggttggaaagtaacaaaccatgacttctgtcaccgacggtgtttcaggtgatcatagagctgatgagcagcagaagcaagctgctgctcaagggaaccaggaagaggccccagctactagtataggtagtcaggcaatggtggcaacaccttccacagattatgtcacaccctatggccaccaggaagcttgccatgcaatgggtcaaattgcttacccaactgtcgatccattctatggaagcctttatgcagcctacggtggacaacctatgatgcatccaccaatggtcggaatgcatgcagccgcaataccgttgcctactgatgcaattgaagagcctgtgtatgtgaatgcaaagcaatataatgccatattaaggcggcgccaatctcgggctaaagcagagtcagaaaggaagcttatcaagggccgcaagccatatctccatgagtcgcggcatcaacatgccttgaaaagggccaggggagccggaggccggtttcttaacgcaaagtcagacgacaatgaagagcattctgattccagctccaaagataagcagaatggcgttgcaccccgcagcagtggccaatcctcccaatctcccaaaggcgcgacttcggctgataagtcagcaaaccatgaatgagatgctagaaggtccgccggacgcgacgatccatgccaacagttttgtacagtatatatatgctagtgagcgagagagagtcgcgccggcgggtgccataggatatatccgctctgctctatagtagtgatagacttatcgacagatttttttgcagcattggtccgtgtttgctcggtttggtttctacattctgtacaatgagtagttttttttgtggtttttgtgttccggggttagccgcgggtttggtcaggaggcttttgtagcttataaaagaagtataattagtgctacattgttttctttggtgtggatttggtctcttagctgtgctgcatcctcattcgtggtgcagaaaataatatctgggtatacataataatagctctgcctgcagctttctttgccaaaaaaaa

SEQ ID NO: 92 - protein, 210 aa, Triticum aestivum
MTSVTDGVSGDHRADEQQKQAAAQGNQEEAPATSIGSQAMVATPSTDYVTPYGHQEACHAMGQIAYPTVDPFYGSLYAAYGGQPMMHPPMVGMHAAAIPLPTDAIEEPVYVNAKQYNAILRRRQSRAKAESERKLIKGRKPYLHESRHQHALKRARGAGGRFLNAKSDDNEEHSDSSSKDKQNGVAPRSSGQSSQSPKGATSADKSANHE

SEQ ID NO: 93 - DNA, 1378 bp, Triticum aestivum
gcacgaggagattcccctctccgcggcgcagacgaccacccgccggccgcccctgccgtcgctctgctaggcagcgatgatgagcttcaagggccacgacggattcgggcaggcctccaatggtggtggtggtggtggagcctccgtgccatggtggacggtgtcccagatgctgtacggggagccgggggccgccttgtcgtcgtcgccggaggcggagcctcgccgggacgcccagttccaggtcgtgcccagagctcagggcatcctggatccactgccggcgcccaagagcggggctcctgaggtcctcaagttctcggtgttccaagggaatttggagtcgggaggcaacaaaggagagaagcccatggagcactccgccaccatcgcactgcagtcgccgctcccggaatacaacagtcgcttcgaatttggcccgggtccttccatgatgtcttctggttatccttcagccgagcagtgctatggcctgcttaccacttacgcgatgaaatctacgcctggtggccgattgctcttgccactgaatgcaacagctgacgcgccgatttacgtgaatgcgaagcagtatgaaggcatccttcgccgccgccgtgctcgtgccaaggtggagcgagagaatcagctggtgaaaggaagaaagccgtatcttcacgaatcacgccaccgccacgcgatgcgccgggcgaggggcacgggagggcgcttcctcaacaccaagaaggaggggaatggcaaggacgctggaggaggaggcaagagggcagagtgcgccccgcccacgcgcttcgccacgtctccgagctccgtcatcccgagcaacccgcactcccggagcagcatctcgagcctctccggctcggaggtgtcgagcatgtacgaccacgacgacgtggaccactacaacagcatcgagcacctccggacgcccttcttcaccccgctgccgatcatcatggacggcgagcacggggcatccgcccccttcaagtgggccacggccgccgacggctgctgtgagctcctcaaggcgtgacttgaggggggtacacgcaggcacccagatcaagagccggccatggccggctctggctccgtctggttgtctgcaggcaaatcattcttggctctactgcattggggtgtccttccacgtcgcattacctcttccctgagaactccggtgctggttctcagggatcttgtgatgatggggctccccatatgcctgtaaaatagtatcggaagcactagcagtgtactacgggtatgaactctgtggtactatcaggtatctgtgtcagaactcagaataagtatcaaacttcagggtctaaaaaaaaaaaaaaaaaaa

SEQ ID NO: 94 - protein, 327 aa, Triticum aestivum
MMSFKGHDGFGQASNGGGGGGASVPWWTVSQMLYGEPGAALSSSPEAEPRRDAQFQVVPRAQGILDPLPAPKSGAPEVLKFSVFQGNLESGGNKGEKPMEHSATIALQSPLPEYNSRFEFGPGPSMMSSGYPSAEQCYGLLTTYAMKSTPGGRLLLPLNATADAPIYVNAKQYEGILRRRRARAKVERENQLVKGRKPYLHESRHRHAMRRARGTGGRFLNTKKEGNGKDAGGGGKRAECAPPTRFATSPSSVIPSNPHSRSSISSLSGSEVSSMYDHDDVDHYNSIEHLRTPFFTPLPIIMDGEHGASAPFKWATAADGCCELLKA

SEQ ID NO: 95 - DNA, 1192 bp, Triticum aestivum
gcacgagggagtgacgcggtcgaggaggggcgtgcggggggcagacagagagggagcgcaaagggacggcggaggcaagctagcttcccgggggcggacgcaccgagagagggcggcgggagggaggaggcgcgtgggagccatgcttctcccctcttcttcgtcttcctcctacgatcccaaaggtgactcctttgggaaatcggttgacgatcatatgaggtcaactttgacttttggtgataagcattctgtatatgcaggtcaaaacactgactatggccacccaatggcttgcatttcatacccgttcaacgattctggttctggagtttgggcggcctatgggtcacgggctatgttccagcccctcatggcgggcggaggggcatctgcaacggcaagagttccattgcccgtcgaactagcagcggatgagcccatatttgtcaatcccaaacaatataatgggattctccggcgaaggcagctgcgcgctaagttagaggcccagaataaactcaccaaaaacagaaagccctacctccacgagtcgcgccatcttcacgcgatgaagcgggcaagaggttccgggggacgtttcctcaattccaaacagctgaagcagcagcagcagtctggcagtgcctgcaccaaggccattgcggatggcgcgaattccctgggttcgacccatctacggctaggcagcggcgcagccggagaccgaaccaactcggtgtccaaggcgatgtcctcccaagagaacagcaagagagtcgccgccccggctcccgccttcaccatgattcaagcggcgcgcaaagacgacgacttcttccaccatcacgcccaccatctcagcttctccggtcattttggccagtcaagcgaccgatatacgtaataaggggtcctccgcgccccggtgtggtcaggcaactcatccttggctttatttctggcgtgttaggacttcagagatagtttatctcacagtgctttgcagcccatagttctcggcttgatgttcggtatgcaaatgttggtgtactggtgcgttggaacaaaagtttgatgtgttcacatgacgattggtcgcggaactcatcttgtgttctgctcgaccctaaaaaaaaaaaaaaaaaaaaaaaaaaaaaaaaaaaaaaaaaaaaaaaaaaaaaaaaaaaac

SEQ ID NO: 96 - protein, 254 aa, Triticum aestivum
MLLPSSSSSSYDPKGDSFGKSVDDHMRSTLTFGDKHSVYAGQNTDYGHPMACISYPFNDSGSGVWAAYGSRAMFQPLMAGGGASATARVPLPVELAADEPIFVNPKQYNGILRRRQLRAKLEAQNKLTKNRKPYLHESRHLHAMKRARGSGGRFLNSKQLKQQQQSGSACTKAIADGANSLGSTHLRLGSGAAGDRTNSVSKAMSSQENSKRVAAPAPAFTMIQAARKDDDFFHHHAHHLSFSGHFGQSSDRYT

SEQ ID NO: 97 - DNA, 1260 bp, Triticum aestivum
gcacgagaagattatctctgtaaactataagttctgacaggtcttttgctttattagtggctcttctctctgatgatgttcacatcgccgaagccccatttacagtgaggtgaattgatgcgattatatcttcatgctaacagtaacaccctttttgtttcagacaatgacaatgatcatgggaagcccgatcagcacatggtaaagccgcttttatctttggggaacccagagactgttgctcccccaccaatgcttgattgtagccaatcatttgcatatattccttatactgctgatgcttatgctgggatctttccaggatatgcctcgcacgctattgttcatccccaattgaatgctgcaacaaactctcgtgtgccgctccctgttgagcctgcagcagaagagccaatgtttgttaatgcaaagcagtaccatgcaattcttaggaggaggcagatacgtgctaaattggaggcccaaaataagctggtgaaagcccggaagccataccttcatgaatctcggcaccgccatgccatgaagcgagctcgtggaacaggagggcggttcctcaacacaaagcaactcgaggagcagaagcagaagcaggcttcaggtggtgcaagctgtacaaaggtccttggcaagaatacactccttcagagtagccccgccttcgcaccttcggcatcagctccctccaacatgtcaagcttttcaacaaccggcatgttggctaatcaagagcgcacctgcttcccctcggttggcttccgtcccacggttagcttcagtgcactgaatggcaacgggaagctggccccaaacggcatgcaccagcgcgcttccatgatgaggtaaagcaaagcaccctctggtgcgctgccggtggcaattcatccttggcttatgaagatgttccggaaatgtggttgcaatatcagctggaccaagacattgttatgagtccttttgagtttcatctagttgaaagcactggtgtgctgatgcagactgaaatcttcatcacatttcttttgtgtgtacttattcaaataaggcacaccttgattatcccagagaccggagttgggcatggttgcgaaaccataggcctatacttccttacctgttgtgaatgtatctggtaatgtacttaagagatggttgagcctcgagctttgatgaatgctgttgcagttcatcaactttgcaacctggtttgcctgatttcaaaaaaaaaaaaaaaaaaaa

SEQ ID NO: 98 - protein, 249 aa, Triticum aestivum
MRLYLHANSNTLFVSDNDNDHGKPDQHMVKPLLSLGNPETVAPPPMLDCSQSFAYIPYTADAYAGIFPGYASHAIVHPQLNAATNSRVPLPVEPAAEEPMFVNAKQYHAILRRRQIRAKLEAQNKLVKARKPYLHESRHRHAMKRARGTGGRFLNTKQLEEQKQKQASGGASCTKVLGKNTLLQSSPAFAPSASAPSNMSSFSTTGMLANQERTCFPSVGFRPTVSFSALNGNGKLAPNGMHQRASMMR

SEQ ID NO: 99 - DNA, 887 bp, Canna edulis
gcacgagattcactcccagttcttctccccggttttccgcctctctccgcaggttttcgacgtctggtttgccctaaatcagctgaatggatcagccgcctggccaccccgccgtccctccggtgatgggcgtcgccgctggagtgccttatgcaactgccgctgccgccggaccctatcaggcctaccagaacctctaccaccagcagcaacagcagcagcagcaacaactccagatgttctgggccgaccagtaccgtgagatcgagcaaactaccgacttccggaaccacagcctgccgctcgcgcggatcaagaagatcatgaaggccgacgaggacgtgcgtatgatcgctgccgaggcgcctgtggtgttcgcccgcgcctgcgagatgttcatcctggaactcacccaccggtcgtgggctcacgccgaggagaacaagcgccggacactgcagaagaacgatatagccgcggccatcagccgcaccgacgtgttcgattttctcattgatatcgtgccaagggaggaggggaaggaagatgttgcccacgccctcggacccccagctggtggtgaccccctcgcttactattatgtccagaagtagaagctgctgctgtgtgagtctttaattaaatgtctccatgttctcaatttcataaatgccttagtgtgattataaacatagggcatggggtttggtttgttacctgaagtgcactgaatttaatctctagtgaacttgctttgcatagctggtgatgtgttcttgttagtaagtttatattgtttgggtattgtccatctaactacatgtatgcttatggcaagcatcattacattgatatggatgggcatttacgctgctctcattcgcgcc

SEQ ID NO: 100 - protein, 175 aa, Canna edulis
MDQPPGHPAVPPVMGVAAGVPYATAAAAGPYQAYQNLYHQQQQQQQQQLQMFWADQYREIEQTTDFRNHSLPLARIKKIMKADEDVRMIAAEAPVVFARACEMFILELTHRSWAHAEENKRRTLQKNDIAAAISRTDVFDFLIDIVPREEGKEDVAHALGPPAGGDPLAYYYVQK

SEQ ID NO: 101 - DNA, 988 bp, Vitis sp.
caaaaaaaaaatcccaaaacaagcagagacaccctcctccctcgaatcaaattacaaagaaatggagaacaaccagcaggcccaatcctccccatacccaccacagcaaccctttcaccatcttctgcagcagcaacagcagcagcttcagatgttttggtcctaccaacgccaagagatcgagcaggtgaacgacttcaagaaccaccaactgcctctggcccgcatcaagaagattatgaaggcggatgaggatgtccggatgatctcggcggaggccccaatcctcttcgccaaggcctgcgagctcttcattctggagctgacgataaggtcgtggttgcacgcggaggagaacaagaggaggacactgcagaagaatgatatcgccgcggcgattactaggacggatatatttgattttttggtggatattgtgccgagggatgagatcaaggacgaggggggcttggggatggtagggtcgacggccagtggggtgccgtactattatccgccgatggggcagcccgcgccgggagtaatgatgggaaggccggcggttccgggggtggatccgggggtgtacgtgcagccgccgtcgcaggcatggcagtcggtgtggcagacggcagaggacgggtcgtacgggagcggagggagcagtggacaggggaatcttgatggccaaggttaagcaaacgcccattgtggatgttgtggtgcttcccggcatgatggaaactatcgagctcgtggacagaacttggattttccttggctatgaattgctctgttattatttgtgaaaactagttggtttttaatgtaatggcttcaattagaaacttgttaaaaaccgtgatttggaccagtgcagtgatatgactcaactaatcctatgtgcagttctaaatgtaaggtccatgtttttcattttaactgaatgattctagttatctgattaaaaaaaaaaaaaaaaaaaaaa

SEQ ID NO: 102 - protein, 211 aa, Vitis sp.
MENNQQAQSSPYPPQQPFHHLLQQQQQQLQMFWSYQRQEIEQVNDFKNHQLPLARIKKIMKADEDVRMISAEAPILFAKACELFILELTIRSWLHAEENKRRTLQKNDIAAAITRTDIFDFLVDIVPRDEIKDEGGLGMVGSTASGVPYYYPPMGQPAPGVMMGRPAVPGVDPGVYVQPPSQAWQSVWQTAEDGSYGSGGSSGQGNLDGQG

SEQ ID NO: 103 - DNA, 1572 bp, Zea mays
ccacgcgtccgcataagaaaaaaaatgaagcttgccatttcgctcagggccctgcagcggcggcagctggcgggagagaggcttgggactgggccgcccggccgcgaggaataaactcactcctgtcttcatacgtatccatagccggcaggcggcagtacctgtatgtggttttagctatacgcgacctcagttcgggcgcaagctacaaccccgaccaggcgagaagaagcatcgatagtgtgacgagctaacccaccaccagcaacgtaatccaaatccatggacaaccagccgctgccctactccacaggccagccccctgcccccggaggagccccggtggcgggcatgcctggcgcggccggcctcccacccgtgccgcaccaccacctgctccagcagcagcaggcccagctgcaggcgttctgggcgtaccagcgccaggaggcggagcgcgcgtccgcgtcggacttcaagaaccaccagctgcctctggcccggatcaagaagatcatgaaggccgacgaggacgtgcgcatgatctccgccgaggcgcccgtgctgttcgccaaggcctgcgagctcttcatcctcgagctcactatccgctcctggctccacgccgaggagaacaagcgccgcaccctgcagcgcaacgacgtcgccgcggccatcgcgcgcaccgacgtcttcgatttcctcgtcgacatcgtgccccgcgaggaggccaaggaggagcccggcagcgccctcggcttcgcggcgcctggtaccggcgtcgtcggggctggcgccccgggcggggcgccagccgccgggatgccctactactatccgccgatggggcagccggcgccgatgatgccggcctggcatgttccggcctgggacccggcctggcagcaaggggcagcggatgtcgatcagagcggcagcttcagcgaggaaggacaagggtttggagcaggccatggcggcgccgctagcttccctcctgcgcctccgacctccgagtgatcgatcggcgcgtctcttggtcctggcctcctggcttagctacatgtgcatgatgtcaatcgttcaatgtgccatgctgtgtatactctacagcaaacgtggtaatggagctgctatgcatacagaacgaataaggcgtgacgtgtgagaccgtaagagtacgtagtactaatatgtagatgcacgtgacgtgccaattaatcaaagattaacatgcagttaattaattagtcctcctaccgaggtgcctcatctatattttttttccatttatatatcgagttcacacaatccataagaatacaaacttcggcaaggtttaggatttggggaacttgaggcttggggagttagggttccatggctaccggtcgtgatgacacatggggcatcaaggtagattaagggtctgtttgtttgaacttttagagtttttttgaaaagttgttgttgaacttttgatactgagaagccaattcaacgatgttattagttcctgaaaaaaaaaaaaaaaaaaaaaaaaaaaaaaaaaaaaaaaaaaaaaaaaaaaag

SEQ ID NO: 104 - protein, 245 aa, Zea mays
MDNQPLPYSTGQPPAPGGAPVAGMPGAAGLPPVPHHHLLQQQQAQLQAFWAYQRQEAERASASDFKNHQLPLARIKKIMKADEDVRMISAEAPVLFAKACELFILELTIRSWLHAEENKRRTLQRNDVAAAIARTDVFDFLVDIVPREEAKEEPGSALGFAAPGTGVVGAGAPGGAPAAGMPYYYPPMGQPAPMMPAWHVPAWDPAWQQGAADVDQSGSFSEEGQGFGAGHGGAASFPPAPPTSE

SEQ ID NO: 105 - DNA, 1164 bp, Zea mays
gcacgagtctccccccattctccaatccgtgccctagtcgagccagccgcgaggaaggaggcgtctcgcctagcgcccgcccgtcggccgaccttctgctgcaccttcgaactctggaaagatcatagatttttgggcaatagcaagtggacatggaaccatcctctcagcctcagcctgcgatgggtgtcgccgccggtgggtcacaagtgtatcctgcgtctgcctacccgcctgcagcaacagtagctcctcctgctgttgcatctgctggtttacagtcagtgcaaccattcccagccaaccctgcccatatgagtgctcagcaccagattgtctaccaacaagctcaacagttccaccaacagctccagcagcagcaacagcagcagcttcagcagttctgggtcgaacgcatgactgaaatcgaggcaacagctgatttcaggaaccacaacttgccacttgcgaggataaagaagatcatgaaggccgacgaagatgtccgcatgatctcagccgaagctcccgtggtcttcgcaaaagcttgcgagatattcatactggagctgacgctgaggtcgtggatgcacaccgaggagaacaagcgccgcaccttgcagaagaacgacattgccgcagccatcaccaggaccgacatttacgacttcttggtcgacattgttcccagggatgagatgaaggacgacggaatcgggcttcctaggcccgggctgccacccatgggagccccagctgacgcatatccatactactacatgccacagcagcaggtgcctggtcctgggatggtttatggcgcccagcaaggccacccggtgacgtatctgtggcaggatcctcaggaacagcaggagcaagctcctgaagagcagcagtctctgcatgaaagggactgaggatgtcgctcaagctatcacctgatttttcagagctctcattttaggttctctaaactgcaggttttcgttggctaatatcgttgggtatcaaactgaaacaggtagggtgtagcatcatggtagtttgatttctgctgtggtgttagttggagggataatgattagcggctagtggattaaagttacccataccgtttcctttcgttccaaaaaaaaaaaaaaaaaaaaaaaaaaaaaaaaa

SEQ ID NO: 106 - protein, 255 aa, Zea mays
MEPSSQPQPAMGVAAGGSQVYPASAYPPAATVAPPAVASAGLQSVQPFPANPAHMSAQHQIVYQQAQQFHQQLQQQQQQQLQQFWVERMTEIEATADFRNHNLPLARIKKIMKADEDVRMISAEAPVVFAKACEIFILELTLRSWMHTEENKRRTLQKNDIAAAITRTDIYDFLVDIVPRDEMKDDGIGLPRPGLPPMGAPADAYPYYYMPQQQVPGPGMVYGAQQGHPVTYLWQDPQEQQEQAPEEQQSLHERD

SEQ ID NO: 107 - DNA, 1270 bp, Zea mays
gcacgaggacgagacagagagagaaggccaagaggcttcctctccccattcctcccttccgtgccctagccgagccagccgcgaggaaggaggcatcccgccgtctcgcctggcgcccgcccgtcggccgaccttctgccgcagcttccaattgtaaaaagatcatagatttttgtgcaagagcgagtggatatggaaccatcccctcagcctatgggtgtcgctgccggtgggtcacaagtgtatcctgcctctgcctatccgcctgcagcaacagtagctcctgcttctgttgtatctgctggtttacagtcagggcagccattcccagccaatcctggtcatatgagtgctcagcaccagattgtctaccaacaagctcaacaattccaccaacagctccagcagcaacaacaacagcagcttcagcagttctgggttgaacgcatgactgaaattgaggcgacgactgatttcaagaaccacaacttgccacttgcgaggataaagaagatcatgaaggccgatgaagatgttcgcatgatctcagctgaagctcctgtagtctttgcaaaagcttgtgagatattcatactggagctgacacttaggtcgtggatgcacactgaggagaacaagcgccgcaccttgcaaaagaatgacattgcagcagcgatcactaggactgacatttatgacttcttggtcgacattgttcccagggatgagatgaaggaggacggaattgggcttcctagggctggtctgccacccatgggagccccagctgatgcatatccatactactacatgccacagcagcaggtgcctggttctggaatggtttatggtgcccagcaagggcacccagtgacttatttgtggcaggagcctcagcaacagcaggagcaagctcctgaagagcagcaatctgcatgaaagtggctgagaatattgctcagaagctatcacctgattcagagttctcattttaggttgtccaaactgcaggttttcttagtaatatcgttggttatcaaactgaaacaggcgattctaagtagggtgtagcatcatggtagtttcatttctgcttgtgatgttagttgaaaggataatgattagtggctagtggattaaagttaccataccatttccttctattccgaaagtttgcctccatgaggcctctgatatgacgtgctagttgttaatgcttcaaaaaaaaaaaaaaaaaaaaaaaaaaaaaaaaaaaaaaaaaaaaaaaaaa

SEQ ID NO: 108 - protein, 248 aa, Zea mays
MEPSPQPMGVAAGGSQVYPASAYPPAATVAPASVVSAGLQSGQPFPANPGHMSAQHQIVYQQAQQFHQQLQQQQQQQLQQFWVERMTEIEATTDFKNHNLPLARIKKIMKADEDVRMISAEAPVVFAKACEIFILELTLRSWMHTEENKRRTLQKNDIAAAITRTDIYDFLVDIVPRDEMKEDGIGLPRAGLPPMGAPADAYPYYYMPQQQVPGSGMVYGAQQGHPVTYLWQEPQQQQEQAPEEQQSA

SEQ ID NO: 109 - DNA, 511 bp, Zea mays
  unsure (442): n = A, C, G, or T
  unsure (452): n = A, C, G, or T
  unsure (474): n = A, C, G, or T
  unsure (497): n = A, C, G, or T
  unsure (504): n = A, C, G, or T
gactcaactcagtgctcagcaccagatggtgtaccagcaggctcagcaatttcatcaacaacttcagcaacagcaggaacaacagctcagggagttctggactacccagatggatgagatcaagcaagcaaatgacttcaagatccacaccttgccacttgcaaggataaagaagataatgaaggctgatgaggatgtgcggatgatctctgcagaagctcctgttgtgtttgcgaaggcatgcgaggtattcatattagagctgacattgaggtcatggatgcacacagaggagaacaagcgccggaccttgcagaagaacgacattgcagctgccatcaccaggactgatatatatgacttcttggtggacataatcccgagggatgaaatgaaagaggaagggcttcggacataatcccatagttggcctgccgcctgntatgggggcntccagcttgatcatgggtcttnatccattattactatgtggccanttaacangtgccaa

SEQ ID NO: 110 - protein, 135 aa, Zea mays
TQLSAQHQMVYQQAQQFHQQLQQQQEQQLREFWTTQMDEIKQANDFKIHTLPLARIKKIMKADEDVRMISAEAPVVFAKACEVFILELTLRSWMHTEENKRRTLQKNDICSCHHPGLIYMTSLVDIIPRDEMKEE

SEQ ID NO: 111 - DNA, 499 bp, Zea mays
  unsure (278): n = A, C, G, or T
  unsure (368): n = A, C, G, or T
  unsure (390)..(391): n = A, C, G, or T
  unsure (452): n = A, C, G, or T
  unsure (468): n = A, C, G, or T
  unsure (474): n = A, C, G, or T
  unsure (480): n = A, C, G, or T
  unsure (486): n = A, C, G, or T
ctttctcccctgttgttgttgatccaaaaagccacctccccccaacccaatcccgtcgtcactctctcactccactgcctccggaacaccctagcaatggatcccaactccagcatccctcccccggtgatgggcgcggcggtggcgtaccctccggcggccggcgccgcgtactccgccgggccgtacgcgcacgcgcacgcggcgttgggcgcgctgtacccgcctcccccggcgccgggtcccccctcctcgcaccagggcggcgcggcggcggngcagctgcagctgttctgggcggagcagtaccgcgagatcgaggcgacgacggacttcaagaaccacaacctgccgctgggccgcatcangaagatcatgaaggcggacganngactgcgcatgatcgccgccgaggcgccggtggtgttcgcccgcgcctgcgagatgttcancctggagctgaccaancgcggntgggcncacgcngaggaaaaaaaac

SEQ ID NO: 112 - protein, 134 aa, Zea mays
  UNSURE (61): Xaa = any amino acid
  UNSURE (91): Xaa = any amino acid
  UNSURE (98)..(99): Xaa = any amino acid
  UNSURE (119): Xaa = any amino acid
  UNSURE (124): Xaa = any amino acid
MDPNSSIPPPVMGAAVAYPPAAGAAYSAGPYAHAHAALGALYPPPPAPGPPSSHQGGAAAXQLQLFWAEQYREIEATTDFKNHNLPLGRIXKIMKADXXLRMIAAEAPVVFARACEMFXLELTXRGWAHAEEKK

SEQ ID NO: 113 - DNA, 1060 bp, Zea mays
gcacgagaagcaccttcctcttcctcttcctccgccccccaatccccctcgtctcacaaccctagctgcccccgaatccatggatcccaacaaatccagcaccccgccgccgcctccagtcatgggtgcccccgttgcctaccctccgccggcgtaccctcccggtgtggccgccggcgccggcgcctacccgccgcagctctacgcgccgccggctgctgccgcggcccagcaggcggcggccgcgcagcagcagcagctgcagatattctgggcggagcagtaccgcgagatcgaggccactaccgacttcaagaatcacaacctcccgctcgcccgcatcaagaagatcatgaaagccgacgaggacgtccgcatgatcgccgccgaggctcccgtggtgttcgcccgggcctgcgagatgttcatcctcgagctcacccatcgcggctgggcgcacgccgaagagaacaagcgccgcacgctccagaaatccgacattgccgctgccatcgcccgcaccgaggtattcgacttccttgtggacatcgttccgcgcgacgacggtaaagacgctgatgcggcggccgccgcagctgccgcggctgccgggatcccgcgccccgccgccggagtaccagccaccgaccctctcgcctactactacgtgcctcagcagtaatgtatcatcatcacgttattgttccgtctatgtgcctgagcaataatgtatcatcattgccttattgttccggggcagttgtgttatttgtgtctgtttagttgctgctgctgttaccgcgtaatagcatatgtgttatctgtgtctgtttagttgctgctgctgttgccgcgtaataaaacttggtcgtttacggggctccctcaagattaagaattgagttgtttgatggtagaatcctggtaaggttgttgtaactggggggcgcctttgtttgggctggtagtgtatgcctaggcctcacttatctgatgctgtaatgcgacaagtattatgtggttgtctggtaattattgtgcaaaaaaaaaaaaaaaaaaa

SEQ ID NO: 114 - protein, 200 aa, Zea mays
MDPNKSSTPPPPPVMGAPVAYPPPAYPPGVAAGAGAYPPQLYAPPAAAAAQQAAAAQQQQLQIFWAEQYREIEATTDFKNHNLPLARIKKIMKADEDVRMIAAEAPVVFARACEMFILELTHRGWAHAEENKRRTLQKSDIAAAIARTEVFDFLVDIVPRDDGKDADAAAAAAAAAAGIPRPAAGVPATDPLAYYYVPQQ

SEQ ID NO: 115 - DNA, 901 bp, Zea mays
gcacgagtgaccgccggaacaccctaggcaatggagcccaaatccaccacccctcccccgccccccgtgatgggcgcgcccatcgcgtatcctcccccgcccggcgccgcgtaccccgccgggccgtacgtgcacgcgccggcggccgcgctctaccctcctcctcccctgccgccggcgcccccctcctcgcagcagggcgccgcggcggcgcaccagcagcagctattctgggcggagcaataccgcgagatcgaggccaccaccgacttcaagaaccacaacctgccgctcgcccgcatcaagaagatcatgaaggccgacgaggacgtgcgcatgatcgccgccgaggcgcccgtcgtcttctcccgcgcctgcgagatgttcatcctcgagctcacccaccgcggctgggcacacgccgaggagaacaagcgccgcacgctgcagaagtccgacatcgccgccgccgtcgcgcgcaccgaggtcttcgacttcctcgtcgacatcgtgccgcgggacgaggccaaggacgccgactccgccgccatgggagcagccgggatcccgcaccccgccgccggcctgcccgccgccgatcccatgggctactactacgtccagccgcagtaacgaatttgcttccttatcatggtttcgcttccatgcagcctttgcgggtttttagtaaactattattattactgagagtgccctgttgttacccatgctctgttgttgccacccaataactcgatgacctgatgatcatctgatgtgcctcccgttccgtaacaagtgattccatttctgattaaaaaaaaaaaaaaaaaaaaaaaaaaaaaaaaaaaaaaaaaaaaaaaaaaaaaaaaaaaaccaaaaaaaaaaaaaaaaaaaaaaa

SEQ ID NO: 116 - protein, 200 aa, Zea mays
MEPKSTTPPPPPVMGAPIAYPPPPGAAYPAGPYVHAPAAALYPPPPLPPAPPSSQQGAAAAHQQQLFWAEQYREIEATTDFKNHNLPLARIKKIMKADEDVRMIAAEAPVVFSRACEMFILELTHRGWAHAEENKRRTLQKSDIAAAVARTEVFDFLVDIVPRDEAKDADSAAMGAAGIPHPAAGLPAADPMGYYYVQPQ

SEQ ID NO: 117 - DNA, 1118 bp, Oryza sativa
cacacacagctacaaatcgactgtaattaaggtacgtatatataggtgacaatggacaaccagcagctaccctacgccggtcagccggcggccgcaggcgccggagccccggtgccgggcgtgcctggcgcgggcgggccgccggcggtgccgcaccaccacctgctccagcagcagcaggcgcagctgcaggcgttctgggcgtaccagcggcaggaggcggagcgcgcgtcggcgtcggacttcaagaaccaccagctgccgctggcgcggatcaagaagatcatgaaggcggacgaggacgtgcgcatgatctcggcggaggcgcccgtgctgttcgccaaggcgtgcgagctcttcatcctggagctcaccatccgctcgtggctgcacgccgaggagaacaagcgccgcaccctgcagcgcaacgacgtcgccgccgccatcgcgcgcaccgacgtgttcgacttcctcgtcgacatcgtgccgcgggaggaggccaaggaggagcccggcagcgcgctcgggttcgcggcgggagggcccgccggcgccgttggagcggccggccccgccgcggggctgccgtactactacccgccgatggggcagccggcgccgatgatgccggcgtggcatgttccggcgtgggacccggcgtggcagcaaggagcagcgccggatgtggaccagggcgccgccggcagcttcagcgaggaagggcagcaaggttttgcaggccatggcggtgcggcagctagcttccctcctgcacctccaagctccgaatagtgatgatccatatggttccatgcatgcatcgctgaggtgctagctagctactatagctgctcaaatcaaatgctcaatgtgtcggtaattaattaatgtggtacgtattaacttaaccgatgtacgtaatggacgctcaagctaattaagggatgtacaatttactaattaatttaatttgtaatatatagccgattaactagcaaggtgacccagtactatttgtaatttcttttcccgttatgctactaattgtggacgcacaaaccattaccggaacagaaattactactgatgaattactataaaaaaaaaaaaaaaaaaaa

SEQ ID NO: 118 - protein, 246 aa, Oryza sativa
MDNQQLPYAGQPAAAGAGAPVPGVPGAGGPPAVPHHHLLQQQQAQLQAFWAYQRQEAERASASDFKNHQLPLARIKKIMKADEDVRMISAEAPVLFAKACELFILELTIRSWLHAEENKRRTLQRNDVAAAIARTDVFDFLVDIVPREEAKEEPGSALGFAAGGPAGAVGAAGPAAGLPYYYPPMGQPAPMMPAWHVPAWDPAWQQGAAPDVDQGAAGSFSEEGQQGFAGHGGAAASFPPAPPSSE

SEQ ID NO: 119 - DNA, 1343 bp, Oryza sativa
tctgacccaagggcgaccgcgtctccctctctctctctctctccgccgccgacgccgagggctccacgagagggaggtgggcggcgcggcccttcgccggagggagcgctctccgccgccgccgctcccgctcccgccggcgcgggagatccgggcgtcgtctctcgggcctttggctttggacggacaagagctgacatggaaccatcctcacagcctcagcctgtgatgggtgttgccactggtgggtcacaagcatatcctcctcctgctgctgcatatccacctcaagccatggttcctggagctcctgctgttgttcctcctggctcacagccatcagcaccattccccactaatccagctcaactcagtgctcagcaccagctagtctaccaacaagcccagcaatttcatcagcagctgcagcaacagcaacagcagcaactccgtgagttctgggctaaccaaatggaagagattgagcaaacaaccgacttcaagaaccacagcttgccactcgcaaggataaagaagataatgaaggctgatgaggatgtccggatgatctcggcagaagcccccgttgtcttcgcaaaggcatgcgaggtattcatattagagttaacattgaggtcgtggatgcacacggaggagaacaagcgccggaccttgcagaagaatgacattgcagctgccatcaccaggactgatatctatgacttcttggtggacatagttcccagggatgaaatgaaagaagaagggcttgggcttccgagggttggcctaccgcctaatgtggggggcgcagcagacacatatccatattactacgtgccagcgcagcaggggcctggatcaggaatgatgtacggtggacagcaaggtcacccggtgacgtatgtgtggcagcagcctcaagagcaacaggaagaggcccctgaagagcagcactctctgccagaaagtagctaaagatgatacagtgaagttgtgacattgatatacattgtcctgtgaacttagggcctctaaaactcagtgctcttgtcaaaactattcccatgattgttggctgaaacgggtaatctgattaggtcttaggctttcctaatgttagttctgctctgctatggcagcagtagaaaaaaaaaagattgtgatttggtaggtgatttgcaactaatgtagtaactgtaccttacctttcatcagtttctaatccaatactcaaaagtgctggcatgtggagacccttgtatgaattgagtgtttgttcatgtcatgcatcagtctgttgcctcatttatcagtcatcatgcctcctgctttgcaaaaaa

SEQ ID NO: 120 - protein, 259 aa, Oryza sativa
MEPSSQPQPVMGVATGGSQAYPPPAAAYPPQAMVPGAPAVVPPGSQPSAPFPTNPAQLSAQHQLVYQQAQQFHQQLQQQQQQQLREFWANQMEEIEQTTDFKNHSLPLARIKKIMKADEDVRMISAEAPVVFAKACEVFILELTLRSWMHTEENKRRTLQKNDIAAAITRTDIYDFLVDIVPRDEMKEEGLGLPRVGLPPNVGGAADTYPYYYVPAQQGPGSGMMYGGQQGHPVTYVWQQPQEQQEEAPEEQHSLPESS

SEQ ID NO: 121 - DNA, 1085 bp, Oryza sativa
gcacgagaaggaatctacgttgcatgcataagacgtgttggaaatatcataagttttgggacaagcaagagaggacatggagccatcatcacaacctcagccggcaattggtgttgttgctggtggatcacaagtgtaccctgcataccggcctgcagcaacagtgcctacagctcctgctgtcattcctgccggttcacagccagcaccgtcgttccctgccaaccctgatcaactgagtgctcagcaccagctcgtctatcagcaagcccagcaatttcaccagcagcttcagcagcagcaacagcgtcaactccagcagttttgggctgaacgtctggtcgatattgaacaaactactgacttcaagaaccacagcttgccacttgctaggataaagaagatcatgaaggcagatgaggacgttcgcatgatctccgcagaggctcctgtgatctttgcgaaagcatgtgagatattcatactggagctgaccctgagatcatggatgcacacggaggagaacaagcgccgtaccttgcagaagaatgacatagcagctgccatcaccaggacggatatgtacgatttcttggtagatatagttcccagggatgacttgaaggaggagggagttgggctccctagggctggattgccgcccttgggtgtccctgctgactcatatccgtatggctactatgtgccacagcagcaggtcccaggtgcaggaatagcgtatggtggtcagcaaggtcatccggggtatctgtggcaggatcctcaggaacagcaggaagagcctcctgcagagcagcaaagtgattaagaagagtaaatgatccctgtgaattgtcaagaagcttaccacctgattcagaattttacttttagccaggttgtcgtctattctgaatttatgaataggattaggattctctcatggtagttgcatttctgctgtagtggaaaaggatttatgacatgagagtatgagactaatgggtttcagttactataccgtttcctgtcaatccaaaagttggcctttgcgaggccattgatataaaaaaaaaaaaaaaaaa

SEQ ID NO: 122 - protein, 250 aa, Oryza sativa
MEPSSQPQPAIGVVAGGSQVYPAYRPAATVPTAPAVIPAGSQPAPSFPANPDQLSAQHQLVYQQAQQFHQQLQQQQQRQLQQFWAERLVDIEQTTDFKNHSLPLARIKKIMKADEDVRMISAEAPVIFAKACEIFILELTLRSWMHTEENKRRTLQKNDIAAAITRTDMYDFLVDIVPRDDLKEEGVGLPRAGLPPLGVPADSYPYGYYVPQQQVPGAGIAYGGQQGHPGYLWQDPQEQQEEPPAEQQSD

SEQ ID NO: 123 - DNA, 893 bp, Oryza sativa
gcacgagaaagagagagcttttccatccccaaatcccctcctcctcctcaaaccctagctaagctccgctcgcagcagccatggatcccaccaaatccagcacgccgccgccggtgatgggcgcgcccgtcggcttcccgcctggcgcgtaccctccgcctccccccggcggcgcagcagcagctgcagatgttctgggcggagcagtaccgcgagatcgaggccaccaccgacttcaagaaccacaacctccccctggcccgcatcaagaagatcatgaaggccgacgaggacgtccgcatgatcgccgccgaggcccccgtcgtgttcgcccgcgcctgcgagatgttcatcctcgagctcacccaccgcggctgggcgcacgccgaggagaacaagcgccgtacgctgcagaagtccgacattgccgccgccatcgcgcgcaccgaggtgttcgacttcctcgtcgacatcgtgccccgcgacgacgccaaggacgccgacgccgccgcggccgcggcggcggccggcatcccccgccccgccgccggtgtgccggccaccgatccgctcgcctactactatgtgccccagcagtaatgtatctgattaacccctttcaagccttttctaagcgaaggatgtgttgttgtttgttgttgctgttgctgttcttgttgttgttgttgccgcgtaataagatatgttgataatttatggcttcccctgagcttaaagaatttgagcttttggttctagaatctgggtaaaattgttgtaatggggaagactgtatgactgtatttgtagtgcatgtcttaacttgtcggatagtgtaatccgataattattatgcggttagctggttacctctcaaaaaaaaaaaaaaaaaa

SEQ ID NO: 124 - protein, 172 aa, Oryza sativa
MDPTKSSTPPPVMGAPVGFPPGAYPPPPPAAQQQLQMFWAEQYREIEATTDFKNHNLPLARIKKIMKADEDVRMIAAEAPVVFARACEMFILELTHRGWAHAEENKRRTLQKSDIAAAIARTEVFDFLVDIVPRDDAKDADAAAAAAAAGIPRPAAGVPATDPLAYYYVPQQ

SEQ ID NO: 125 - DNA, 1054 bp, Glycine max
gcacgaggggtctctctgtctctctcggatcatcaaaatcagaaagaattgggggaatggagaacaaccagcaacaaggcgctcaagcccaatcgggaccgtaccccggcggcgccggtggaagtgcaggtgcaggtgcaggtgcaggcgcggccccgttccagcacctgctccagcagcagcagcagcagctgcagatgttctggtcgtaccagcggcaagagatcgagcacgtgaacgacttcaagaaccaccagctccccttggcccgcatcaagaagatcatgaaggccgacgaggacgtccgcatgatctccgccgaggcccccatcctcttcgccaaggcctgcgagctcttcatcctcgagctcaccatccgctcctggctccacgccgacgagaacaagcgccgcaccctccagaagaacgacatcgccgccgccatcactcgcaccgacattttcgacttcctcgtcgacatcgtcccccgcgacgagatcaaggacgacgccgcgctcgtcggggcaacggccagtggggtgccttactactacccgcccattggccagcctgccgggatgatgattggccgccccgccgtcgatcccgccaccggagtttatgtccagccgccctcccaggcctggcagtccgtctggcagtccgccgccgaggacacgccctacggcaccggtgcccaggggaaccttgatggccagagctgagcgacaaccatgccgaaacggactgtcaggagttatgaagattctgaacttgcttggaattttgattgcttgcaatttggaaatggttttgttaactaaatttttatgggatgacactatgaacctgttaactcgatgaacagcatgatttaactacttctgtacaaaaatttaaaactaaacaatgatccttctgtgtgaacttgtttgatcatctgctaatactatttatttcctcgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 126 - protein, 222 aa, Glycine max
MENNQQQGAQAQSGPYPGGAGGSAGAGAGAGAAPFQHLLQQQQQQLQMFWSYQRQEIEHVNDFKNHQLPLARIKKIMKADEDVRMISAEAPILFAKACELFILELTIRSWLHADENKRRTLQKNDIAAAITRTDIFDFLVDIVPRDEIKDDAALVGATASGVPYYYPPIGQPAGMMIGRPAVDPATGVYVQPPSQAWQSVWQSAAEDTPYGTGAQGNLDGQS

SEQ ID NO: 127 - DNA, 1036 bp, Glycine max
gcacgagcccacacacactctttctctctctctctttccctgatcatcaaaatcagaaaaaattgggggaatggagaccaacaaccagcaacaacaacaacaaggagctcaagcccaatcgggaccctaccccgtcgccggcgccggcggcagtgcaggtgcaggtgcaggcgctcctccccctttccagcaccttctccagcagcagcagcagcagctccagatgttctggtcttaccagcgtcaagaaatcgagcacgtgaacgactttaagaatcaccagctccctcttgcccgcatcaagaagatcatgaaggccgacgaggatgtccgcatgatctccgccgaggcccccatcctcttcgccaaggcctgcgagctcttcatcctcgagctcaccatccgctcctggctccacgccgaggagaacaagcgccgcaccctccagaagaacgacatcgccgccgccatcacccgcaccgacattttcgacttcctcgttgatattgtcccccgcgacgagatcaaggacgacgctgctcttgtgggggccaccgccagtggggtgccttactactacccgcccattggacagcctgccgggatgatgattggccgccccgccgtcgatcccgccaccggggtttatgtccagccgccctcccaggcatggcagtccgtctggcagtccgctgccgaggacgcttcctatggcaccggcggggccggtgcccagcggagccttgatggccagagttgagtgacatcgatgccgatgatggacagtcaggagttatgaagattctgaacttgctgcaatttagaaatggttttgtttactaaatttttatgggatgacactgtgaacctgttaactcgatgaacagcatgatttaactacttttgtacaaaaatttaaaactaaacactgatccttctgtgtgaaacatgtatgatcatctgccaatactgtttatttcctcataagtcatgataccactcgtatactttgctaaaaaaaaaaaaaaaaaaaaaa

SEQ ID NO: 128 - protein, 229 aa, Glycine max
METNNQQQQQQGAQAQSGPYPVAGAGGSAGAGAGAPPPFQHLLQQQQQQLQMFWSYQRQEIEHVNDFKNHQLPLARIKKIMKADEDVRMISAEAPILFAKACELFILELTIRSWLHAEENKRRTLQKNDIAAAITRTDIFDFLVDIVPRDEIKDDAALVGATASGVPYYYPPIGQPAGMMIGRPAVDPATGVYVQPPSQAWQSVWQSAAEDASYGTGGAGAQRSLDGQS

SEQ ID NO: 129 - DNA, 514 bp, Glycine max
  unsure (424): n = A, C, G, or T
  unsure (430): n = A, C, G, or T
  unsure (464): n = A, C, G, or T
  unsure (506): n = A, C, G, or T
tagggttttctcctcccccattgacccaccgtccatcgcaaaggaagtcgcgcccaatttccatggtttgtagattaaatcttaaagcagtaagtcatcatggataaatcagagcagactcagcagcaacatcagcatgggatgggcgttgccacaggtgctagccaaatggcctattcttctcactacccgactgctcccatggtggcttctggcacgcctgctgtagctgttccttccccaactcaggctccagctgccttctctagttctgctcaccagcttgcataccagcaagcacagcatttccaccaccaacagcagcaacaccaacaacagcagcttcaaatgttctggtcaaaccaaatgcaagaaattgagcaaacaattgactttaaaaaccacagtcttcctcttgctcggntaaaanagataatgaaagctgatgaagatgtccggatganttctgcaagaagctccaagtcaatatttgcaaaagcatgtgnaatggtca

SEQ ID NO: 130 - protein, 126 aa, Glycine max
  UNSURE (109): Xaa = any amino acid
  UNSURE (111): Xaa = any amino acid
  UNSURE (122): Xaa = any amino acid
MDKSEQTQQQHQHGMGVATGASQMAYSSHYPTAPMVASGTPAVAVPSPTQAPAAFSSSAHQLAYQQAQHFHHQQQQHQQQQLQMFWSNQMQEIEQTIDFKNHSLPLARXKXIMKADEDVRMXSARS

SEQ ID NO: 131 - DNA, 1363 bp, Glycine max
ttcggcacgagttgaaaccaaaccaaaccaaaccaaaccaaacctctctttctcagtttctctctcttagggttttctcctcccccattgacccaccgtccatcgcaaaggaagtcgcgcccaatttccatggaactgtaaagagattatagtttgtagattaaatcttaaagcagtaagtcatcatggataaatcagagcagactcagcagcaacatcagcatgggatgggcgttgccacaggtgctagccaaatggcctattcttctcactacccgactgctcccatggtggcttctggcacgcctgctgtagctgttccttccccaactcaggctccagctgccttctctagttctgctcaccagcttgcataccagcaagcacagcatttccaccaccaacagcagcaacaccaacaacagcagcttcaaatgttctggtcaaaccaaatgcaagaaattgagcaaacaattgactttaaaaaccacagtcttcctcttgctcggataaaaaagataatgaaagctgatgaagatgtccggatgatttctgcagaagctccagtcatatttgcaaaagcatgtgaaatgttcatattagagttgacgttgagatcttggatccacacagaagagaacaagaggagaactctacaaaagaatgatatagcagctgctatttcgagaaacgatgtttttgatttcttggttgatattatcccaagagatgagttgaaagaggaaggacttggaataaccaaggctactattccattggtgaattctccagctgatatgccatattactatgtccctccacagcatcctgttgtaggacctcctgggatgatcatgggcaagcccgttggtgctgagcaagcaacgctgtattctacacagcagcctcgacctcccatggcgttcatgccatggccccatacacaaccccagcaacagcagccaccccaacatcaacaaacagactcatgatgaccatgcaattcaattaggtcggaaagtagcatgcaccttatgattattacaaatttacttaatgcctttaagtcagctgtagtttagtgttttgcattgaaaaatgccaaagattgtttgaggtttcttgcactcatttatgattgtatgagctcttatgctgagttacttttggttgtgtttatttgaggtactggtgtggtagttaaattagtttgtagctgtccataagtaaacagcgtagctgcttaattaggaggtctgaaatgatgaaatagtttgtattgttattgcagaaggtaggttttattcagtatttcattctattgcaatggctgaatttaatgctcaaaaaaaaaaaaaaaaaa

SEQ ID NO: 132 - protein, 268 aa, Glycine max
MDKSEQTQQQHQHGMGVATGASQMAYSSHYPTAPMVASGTPAVAVPSPTQAPAAFSSSAHQLAYQQAQHFHHQQQQHQQQQLQMFWSNQMQEIEQTIDFKNHSLPLARIKKIMKADEDVRMISAEAPVIFAKACEMFILELTLRSWIHTEENKRRTLQKNDIAAAISRNDVFDFLVDIIPRDELKEEGLGITKATIPLVNSPADMPYYYVPPQHPVVGPPGMIMGKPVGAEQATLYSTQQPRPPMAFMPWPHTQPQQQQPPQHQQTDS

SEQ ID NO: 133 - DNA, 1505 bp, Glycine max
gcacgagctccaccgtccattgcaaagtcttgcgcccaatttccatggaactgtaaagagaggatagttagaagattaaatcttaaagcagtaagtcatcatggataaatcagagcagactcaacagcagcagcagcaacaacagcatgtgatgggagttgccgcaggggctagccaaatggcctattcttctcactacccgactgcttccatggtggcttctggcacgcccgctgtaactgctccttccccaactcaggctccagctgccttctctagttctgctcaccagcttgcataccagcaagcacagcatttccaccaccaacagcagcaacaccaacaacagcagcttcaaatgttctggtcaaaccaaatgcaagaaattgagcaaacaattgactttaaaaaccatagccttcctcttgctcggataaaaaagataatgaaagctgatgaagatgtccggatgatttcagcagaagctccggtcatatttgcaaaagcttgtgaaatgttcatattagagttgacgttgcgatcttggatccacacagaagagaacaagaggagaactctacaaaagaatgatatagcagctgctatttcgagaaacgatgtttttgatttcttggttgatattattccaagagatgagttgaaagaggaaggacttggaataaccaaggctactattccgttagtgggttctccagctgatatgccatattactatgtccctccacagcatcctgttgtaggaccacctgggatgatcatgggcaagcccattggcgctgagcaagcaacactatattctacacagcagcctcgacctcctgtggcgttcatgccatggcctcatacacaacccctgcaacagcagccaccccaacatcaacaaacagactcatgatgactatgcaattcaattaggttggaaagtagcctgcaccttttgattattacaaatttacttaatgcctttcagccagctgtagtttagtgttgtgcattgaaaaaaagcaaaagattgttttgaggtttcttgcactcatttatgattgtatgagctcttgtgatgagttacttttggttgtgtttactattggtgtagtggttaaattatttggcagctgtccataaccagagagcgtagctgcttaattaggaggtttgatatgatgaaatagtttgtattgttattgcagaaggtaggtttaattcagtattccattctactgcaatggctgaatttattgctcatctgcatagtactagttgatgttttttcctgtgactcgttatgtgttagagtgcgaagaagaatgagtgtgccatatttattcttcccctgttcttgcgccacactctcggaaaaacaaatgtttccgatcatttcaattatttccaggaacatcaatatagtggttgatgtttaatgctgtcactgcaaaaaaaaatatgttttttacagttggaaaaaaaaaaaaaaaaaaaaaaaa

SEQ ID NO: 134 - protein, 271 aa, Glycine max
MDKSEQTQQQQQQQQHVMGVAAGASQMAYSSHYPTASMVASGTPAVTAPSPTQAPAAFSSSAHQLAYQQAQHFHHQQQQHQQQQLQMFWSNQMQEIEQTIDFKNHSLPLARIKKIMKADEDVRMISAEAPVIFAKACEMFILELTLRSWIHTEENKRRTLQKNDIAAAISRNDVFDFLVDIIPRDELKEEGLGITKATIPLVGSPADMPYYYVPPQHPVVGPPGMIMGKPIGAEQATLYSTQQPRPPVAFMPWPHTQPLQQQPPQHQQTDS

SEQ ID NO: 135 - DNA, 730 bp, Glycine max
gcacgagtgactttaaaaaccatagccttcctcttgctcggataaaaaagataatgaaagctgatgaagatgtccggatgatttcagcagaagctccggtcatatttgcaaaagcttgtgaaatgttcatattagagttgacgttgcgatcttggatccacacagaagagaacaagaggagaactctacaaaagaatgatatagcagctgctatttcgagaaacgatgtttttgatttcttggttgatattattccaagagatgagttgaaagaggaaggacttggaataaccaaggctactattccgttagtgggttctccagctgatatgccatattactatgtccctccacagcatcctgttgtaggaccacctgggatgatcatgggcaagcccattggcgctgagcaagcaacactatattctacacagcagcctcgacctcctgtggcgttcatgccatggcctcatacacaacccctgcaacagcagccaccccaacatcaacaaacagactcatgatgactatgcaattcaattaggttggaaagtagcctgcaccttttgattattacaaatttacttaatgcctttcagccagctgtagtttagtgttgtgcattgaaaaaaagcaaaagattgttttgaggtttcttgcactcatttatgattgtatgagctcttgtgatgagttacttttggttgtgtttaaaaaaaaaaaaaaaaaa

SEQ ID NO: 136 - protein, 171 aa, Glycine max
DFKNHSLPLARIKKIMKADEDVRMISAEAPVIFAKACEMFILELTLRSWIHTEENKRRTLQKNDIAAAISRNDVFDFLVDIIPRDELKEEGLGITKATIPLVGSPADMPYYYVPPQHPVVGPPGMIMGKPIGAEQATLYSTQQPRPPVAFMPWPHTQPLQQQPPQHQQTDS

SEQ ID NO: 137 - DNA, 1139 bp, Glycine max
gcacgagacacagcttttgttctcgcacttcgctgtctgaggttctggattctcagtgtttgcgaagcgctgcatcatcctttggggaagaatggatcatcaagggcatagccagaacccatctatgggggtggttggtagtggagctcaattagcatatggttctaacccatatcagccaggccaaataactgggccaccggggtctgttgtgacatcagttggtaccattcaatccacacctgctggagctcagctaggacagcatcaacttgcttatcagcatattcatcagcaacaacaacaccagcttcagcaacagctccaacaattttggtcaaaccagtaccaagaaattgagaaggttactgatttcaagaaccacagtcttcccctggcaaggatcaagaagattatgaaggctgacgaggatgttaggatgatatcagccgaagcaccagtcatctttgcaagggcatgtgaaatgttcatattagagttaaccctgcgttcttggaatcacactgaagagaacaaaaggcgaacacttcaaaaaaatgatattgctgctgcaatcacaaggactgacatctttgatttcttggttgacattgtgcctcgtgaggacttgaaagatgaagtgcttgcatcaatcccaagaggaacaatgcctgttgcagggcctgctgatgcccttccatattgctacatgccgcctcagcatgcgtcccaagttggagctgctggtgttataatgggtaagcctgtgatggacccaaacatgtatgctcagcagtctcacccctacatggcaccacaaatgtggccacagccaccagaccaacgacagtcgtccccagaacattagctgatgtgtcgtggaaattaagataaccaggcaccggaatcagttgtgaatgtcaaactgaatggttgggaagatccatactacattgcgagcagaagctgtagctgatagtttacatgcaatgcagactataaacatatgtagataatgtgctagggaaaacttaaccttatctttgatttagctggataaaatggtatttttcatgtttaaatttacaggtcatcagatgataatatttatttactggtgcaaaaaaaaaaaaaaaaaa

SEQ ID NO: 138 - protein, 258 aa, Glycine max
MDHQGHSQNPSMGVVGSGAQLAYGSNPYQPGQITGPPGSVVTSVGTIQSTPAGAQLGQHQLAYQHIHQQQQHQLQQQLQQFWSNQYQEIEKVTDFKNHSLPLARIKKIMKADEDVRMISAEAPVIFARACEMFILELTLRSWNHTEENKRRTLQKNDIAAAITRTDIFDFLVDIVPREDLKDEVLASIPRGTMPVAGPADALPYCYMPPQHASQVGAAGVIMGKPVMDPNMYAQQSHPYMAPQMWPQPPDQRQSSPEH

SEQ ID NO: 139 - DNA, 1493 bp, Triticum aestivum
ggcaccagctctggcttccaagtctatacataatatagggaccgagcttgcggttttgccaagggtgatggggaccgagcaagggaaggaaggaacgggagcgggggaggggcgcgtggaggtgcgcacggggccgaggccagcgctgccggcgccgcagcagcgggcggtggacgggttctggagggagcggcaggaggagatggaggcgacggcggacttcaacgaccgcatactgcccatggcccgcctcaagaggctcatccgcgccgaggaggacggcatgatgatcgccgccgacacgccggcgtacctggccaagctctgcgagctcttcgtgcaggagctcgccgtgcgcgcctgggcgtgcgcccaatcccaccaccgccgcatcatactggaatcggacatcgccgaggccatcgccttcacccagtcgtacgacttcctcgccaccgtgctcctcgagcaccaacgggaggcgcggctggccggccgtgctgctatcccgacaacggttccggtgacggcggcgagggcaaggctcatcaccaggaagcgccacatgccggacccgaatcctccacggccggtgcatggggtgcggagaattcgtcctcgtgcgcttcctatcccgccgccgtcggactttcgctacgtgccggttccatttccgttcacctcggcgccgataggagccgcagcgatggcggaggggctgatgattctcccacccatcaaccacgcgactaccgagcgcgtgttcttcctggacaggaacagcggcactgacttcgcaggtgaaaactctgctgctgaaactatagcatctccgcctcctccggcagggcctgcaggagcagtggcgctgcccactgtccatcctgctgcttactacttgtgcgcttacccggtgaccaacgacgttgaggcctttgccgttggcaacactgatcctgatgtcatcccaccggagattgtagtgggagacgtcgccatcccaccggagattatagagggaaacgtcgccgatggcaacggcgacggcggacagcagcagcagcagagcgaaaaccttggtggtaatggtgagagtgtggtggtgtcgcaaagcaatggtgtgcaggaagatggtgcagatgggatgtttctgaaggagatcctcatggatgaagacctgatgtttcccgacgctgagctttttccgttggtgggcgctgcacctggtccagaggatttcatcgtcgaccaagatgttctcgacgacgtcttcgccaacccgagcagcagcgcaagcagcgactgaaccgaaagaagatcagagcgggacgcagcatcggttgattcatctatcgtctctcgacctgctactctatgctagccgctatatcggttaataaatttgggaataagtttgtgttcgtgcgtgtgacatggactgtatggttcgccctgaatttatcgtattgcaatatatagccgtgattgtgtgt

SEQ ID NO: 140 - protein, 434 aa, Triticum aestivum
APALASKSIHNIGTELAVLPRVMGTEQGKEGTGAGEGRVEVRTGPRPALPAPQQRAVDGFWRERQEEMEATADFNDRILPMARLKRLIRAEEDGMMIAADTPAYLAKLCELFVQELAVRAWACAQSHHRRIILESDIAEAIAFTQSYDFLATVLLEHQREARLAGRAAIPTTVPVTAARARLITRKRHMPDPNPPRPVHGVRRIRPRALPIPPPSDFRYVPVPFPFTSAPIGAAAMAEGLMILPPINHATTERVFFLDRNSGTDFAGENSAAETIASPPPPAGPAGAVALPTVHPAAYYLCAYPVTNDVEAFAVGNTDPDVIPPEIVVGDVAIPPEIIEGNVADGNGDGGQQQQQSENLGGNGESVVVSQSNGVQEDGADGMFLKEILMDEDLMFPDAELFPLVGAAPGPEDFIVDQDVLDDVFANPSSSASSD

SEQ ID NO: 141 - DNA, 660 bp, Triticum aestivum
  unsure (483): n = A, C, G, or T
  unsure (614): n = A, C, G, or T
  unsure (630): n = A, C, G, or T
  unsure (644): n = A, C, G, or T
  unsure (647): n = A, C, G, or T
ggcaccgagctagcttggcaatggccgcgagggcgtgtcctgctgcttctggttaccgtgtgtgctgaagcatctgacgcgcttgcgccgagcagcaggagctagccgttcatgctcttcttccctccccttggcatctgaagcagtaagagctcaagttcacagagggcgttcgtccgatctacaaagcccagctgtacatcgccttagctagcttgcagatcgcaagctagatagtaatggagaaccaccagctgccctacaccacccagccgccggcaacgggcgcggccggaggagccccggtgcctggcgtgcctgggccaccgccggtgccacaccaccacctgctccagcagcagcaggcccagctgcaggcgttctgggcgtaccagcggcaggaggcggagcgcgcatcggcgtccgacttcaagaaccaccagctgccgctggctcggatcaagaagatcatgaaggccgacnaagacgtgcgcatgatctccgcggaggcgcccgtgctcttcgccaaggcctgcgagctctttattctcgaagctcaccattccgcttcctggctgcacgcccgaggaagaacaagccgccgcacaacttgnagcgcaaacgacgttncccgcttgccaatnggngccgccacccgac

SEQ ID NO: 142 - protein, 147 aa, Triticum aestivum
  UNSURE (82): Xaa = any amino acid
  UNSURE (125): Xaa = any amino acid
  UNSURE (131): Xaa = any amino acid
  UNSURE (135): Xaa = any amino acid
  UNSURE (142): Xaa = any amino acid
  UNSURE (145): Xaa = any amino acid
MENHQLPYTTQPPATGAAGGAPVPGVPGPPPVPHHHLLQQQQAQLQAFWAYQRQEAERASASDFKNHQLPLARIKKIMKADXDVRMISAEAPVLFAKACELFILEAHHSASWLHARGRTSRRTTXSANDVXRLPXGAATRRXFEXFL

SEQ ID NO: 143 - DNA, 1874 bp, Triticum aestivum
gcacgagcccacccacaaccctagctcccccgaacccatggatcccaccaaatccagcaccccgccgccgccccccgtcctgggcgcgcccgtcggctacccgccgggggcgtaccctcctccgccgggcgcccccgcggccgcctacccgccgcagctctacgcgccgccgggcgccgccgccgcccagcaggccgcggcgcagcagcagcagcagctgcaggtgttctgggcggagcagtaccgcgagatcgaggccaccaccgacttcaagaaccacaacctcccgctggcccggatcaagaagatcatgaaggccgacgaggacgtccgcatgatcgccgccgaggcccccgtcgtcttcgcccgcgcctgcgagatgttcatcctcgagctcacccaccgcggctgggcgcacgccgaggagaacaagcgccgcacgctccagaagtccgacattgcggccgccatcgcccgcaccgaggtcttcgacttcctcgtggacatcgtgccccgggacgacgccaaggacgccgaggcggccgccgccgcggccatggccacggcggcggccgggatcccgcgcccggccgccggcgtgcctgccaccgacccgagtatggcatactactatgtcccccagcagtaatgtatcatcgatctaaacttgcgcatttctaatcggagaatgtgttgttgttctgtgactgtccttggtgctgttgttgctgcggcgtaataagatttatgggcctcccctgagcttatgaattgagctgttcggttctagtattacagtaggattgttgtaatgggggaggccgtatgattgcttccgtagtgcatgactaactggccacccagtgtaatctgataactattatctggcgcctcccatggttactatgtatttatgttcttcacacagtcctctttgtctctaccacttcgaggagttcttcggaaggatgggctccaagatgcttctggtcaccgctctcttggtgggcatagcctctcagagctatgccaccaggagccttgacggaaaccacttggctgatcagaagtacggcggcggcggctacggaggtggcggtgggggctccggaggtggtggtggctacggaggaggtggcagcggcggcgggggtggctatggaggaggcggcggcggtggctacggaggaggaggcggcggttacacaccgatgccaacaccgtcgacccccagccacagcggatcctgcgactactggaagggccacccggagaagatcatcgactgcatcggcagcctgggcagcatcctgggctccctcggagaggtgtgccactccttcttcggcagcaagatccataccctgcaggacgcgctgtgcaacacccggaccgactgctacggcgacctgctgcgcgagggcgccgccgcctacatcaacgccatcgccgccaagaaggagaagttcgcctacaccgcctaccaggtcaaggagtgcgtcgccgtcgggctcacctccgagttcgccgccgccgcgcaggccgccatgttgaagaaggccaactacgcctgccactactaggaggctaggctaccggccggccgccccagctggtggtcgtcggtggctaaataagtccatatatgcatgcacgtgtcgtgcatgttttcatgcagtttcccggatgcgcgcgcgcgtgtcctccgctatgcctttatgtgtttgcttgccgtttgatgatgcatgccatgccgtctcatatatacgtagtgatgcttaatgctttgcttgcttttcttatcttcgttggtgatgtaagaataatttgattgaggagttattagtgaaagacatagtatgcaaaaaaaaaaa

SEQ ID NO: 144 - protein, 203 aa, Triticum aestivum
MDPTKSSTPPPPPVLGAPVGYPPGAYPPPPGAPAAAYPPQLYAPPGAAAAQQAAAQQQQQLQVFWAEQYREIEATTDFKNHNLPLARIKKIMKADEDVRMIAAEAPVVFARACEMFILELTHRGWAHAEENKRRTLQKSDIAAAIARTEVFDFLVDIVPRDDAKDAEAAAAAAMATAAAGIPRPAAGVPATDPSMAYYYVPQQ

SEQ ID NO: 145 - DNA, 764 bp, Zea mays
ttttgaatccatctctagggctcttgtttctccccaccccaccccccaccaaacacaagtccccttgttcaatccgacaagacaagcatccatgtcgtcgtcacgccggagctcgagccccgacagcaacgacacgacggacgagcgcaagcggaagcggatgctgtccaacagggagtcggcgcggcggtcgcgcgcgcggaagcagcagcggttggaggagctggtggcggaggtggcccgcctgcaggcggagaacgcggcgacgcaggcccgcaccgcggcgctggagcgcgacctgggcagggtggacggcgacaacgcggtgctgcgcgcccgccacgccgagctggccggccgcctgcagtcgctgggcggcgtcctcgaggtgctccagatggccggcgccgccgtcgacatcccggagatggtcaccgacgaccccatgctccgcccctggcagccgtccttccccccgatgcagcccatcgggttctgagaatctgagcctcagccggcgggagagagccaatttctgtcgtcgtgccgctgtctatctcgtattggtatatctattcataaatcatccttgtcatggtttgctcttcttgtcagtgttataaatttgcttcttgttagtgttataaatttggccatcggaaaggatgtgtttgtagttgtaatatcttgtttggagttgtaatatcttatcttgcttatgaaatcgaatatggctatatatataaaaaaaaaaaaaaaaaaaa

SEQ ID NO: 146 - protein, 165 aa, Zea mays
FESISRALVSPHPTPHQTQVPLFNPTRQASMSSSRRSSSPDSNDTTDERKRKRMLSNRESARRSRARKQQRLEELVAEVARLQAENAATQARTAALERDLGRVDGDNAVLRARHAELAGRLQSLGGVLEVLQMAGAAVDIPEMVTDDPMLRPWQPSFPPMQPIGF

SEQ ID NO: 147 - DNA, 500 bp, Zea mays
  unsure (354): n = A, C, G, or T
  unsure (392): n = A, C, G, or T
  unsure (407): n = A, C, G, or T
  unsure (458): n = A, C, G, or T
  unsure (479): n = A, C, G, or T
  unsure (485)..(486): n = A, C, G, or T
  unsure (490): n = A, C, G, or T
  unsure (500): n = A, C, G, or T
gaatccatctctagggctcttgtttctccccaccccaccccccaccaaacacaagtccccttgttcaatccgacaagacaagcatccatgtcgtcgtcacgccggagctcgagccccgacagcaacgacacgacggacgagcgcaagcggaagcggatgctgtccaacagggagtcggcgcggcggtcgcgcgcgcggaagcagcagcggttggaggagctggtggcggaggtggcccgcctgcaggcggagaacgcggcgacgcaggcccgcaccgcggcgctggagcgcgacctgggcaaggtggacggcgacaacgcggtgctgcgcgcccgccacgccgagctgggcggncgcctgcaatcgctgggcggcgtctcgaggtgctccanatgggcgggcgccgncgtcgacatcccggagatggtcaacgacgacccatgctcccgccctgggangcggcctttcccccgatggangcccanncggntccgagaatn

SEQ ID NO: 148 - protein, 137 aa, Zea mays
  UNSURE (102): Xaa = any amino acid
  UNSURE (107): Xaa = any amino acid
  UNSURE (124): Xaa = any amino acid
  UNSURE (131): Xaa = any amino acid
  UNSURE (133): Xaa = any amino acid
  UNSURE (135): Xaa = any amino acid
MSSSRRSSSPDSNDTTDERKRKRMLSNRESARRSRARKQQRLEELVAEVARLQAENAATQARTAALERDLGKVDGDNAVLRARHAELGGRLQSLGGVSRCSXWAGAXVDIPEMVNDDPCSRPGXRPFPRWXPXRXRE

SEQ ID NO: 149 - DNA, 1885 bp, Oryza sativa
  unsure (1259): n = A, C, G, or T
gcacgaggttctaacctatcctttcctcccaagaacaccatctccagcctctaattgattatatcttgatttctttttcatcctcctactagtttctttcttgtgttctttggaatttttttgatctcttgaagagatccggttcttggattaagttttggacaagaaccgtactgtgaccatgtcgtcgccttcgcgccggagctccagcccggagagcaacaccagcggcggcggcggtggcgccgacgagcggaagaggaagaggatgctgtcgaacagggagtcggcgaggcgatccagggcgaggaagcagcagaggctggaggagctgatcgccgaggcggcgcgcctccaggccgagaacgcgcgcgtcgaggcgcagatcggggcctacgcgggggagctgagcaaggtcgacggcgagaacgcggtgctccgcgcccgccacggcgagctcgccgggcgcctccaggcgctcggcagcgtcctggagatcctccaggtggccggcgcgcccgtcgacatcccggagatccccgacgacccgctgctccgcccatggcagccgccgttcgcggcccagcccatcgtcgccaccgccatggccgacgccttccagttctgagccaccatggagagctcgcacgccatggccattggcatcaatggcatggttgcagctgcattacaactagtagtactagcctctgtggttgtgtctgatgatgcttattatgtttaattatggtttgcttcatgttgttttcattaatctagaccattaataagcaatgtgtgttgtaatcttgtctagtcttatgtgagatgtgttcatctccagtgctccttgctaataagggtggaagagaacaatccgatttgatgtaattcttggagagcacatgtgtgctggtttgtgatgtgatgaactgatgattgtaatattttgacattgaacctatgctataatgtttgcagcaatgaatcaaaaaaaaaaaaaaaaaactcgagtacatggacggcgggtccctcgacggccgccgcatcgccgacgagcggttcctcgccgacgtcgcgcgccaggtgctctccgggatcgcctacctccaccgccgccacatcgtccaccgcgacatcaagccgtccaacctcctcatcgactccgcgcgccgcgtcatgatccctgacttcggcgtcggcagcatcctcatccagactatggatcccttgcaactccctcggtgggcaccatcgcntacatgagccccgagcgcatcaacaccgacctcaacgacggcgcctacgatggctacgccggcgacatctggagcttcggcctcagcatcctagagttttacatgggaaaattccccttcggtgagaatcttggcaagcagggtgactgggccgcgctcatgtgcgccatctgctattccgaccctcccgagccgcccgccgccgtctcgccggagttcagaagcttcgtcggctactgccttcagaagaatccggcgaagcggccgtccgccgcgcagctgatgcagcacccgttcgtcgccggaccgcagccacagccactcgccgccccgccgccatcgtcgtgactgccaattccatccggtcatcgtgtcaaactccatttccatctcatcaagttcttcatagccaatccattttcgagtgttcttcaaacaccatgatcgttttcatccattgctgctgccccaactcaaggttcttcctctctactgttctttgatgttgttttattcacaatgatgatcaaatattgagtaaatctggtttgtacaaaggatttttttttctacgagatcaagtacagacataatcccacttgttaaaaaaaaaaaaaaaaaaaaaa

SEQ ID NO: 150 - protein, 148 aa, Oryza sativa
MSSPSRRSSSPESNTSGGGGGADERKRKRMLSNRESARRSRARKQQRLEELIAEAARLQAENARVEAQIGAYAGELSKVDGENAVLRARHGELAGRLQALGSVLEILQVAGAPVDIPEIPDDPLLRPWQPPFAAQPIVATAMADAFQF

SEQ ID NO: 151 - DNA, 955 bp, Glycine max
tggttctacgttttctcatgaactccctcttaaatccgtgattaattagatctatctccttagttaatccttgtcttttccaataattaattagatctgcgtctcctttttggattagtttcttttttggttctgttatcaaatcaaataaaaaatctccttctcggaaatggcatcaccgatccaacaacaacaacgctcgactactacaagttctggatctgaaggaggagatccgcatatcatcgatgagaggaagcggaagaggatgctgtcgaaccgcgagtcggcgcggcgatcgcggatgaggaagcagaaacagctggaggatctgaccgatgaagttagcagattgcaaagcgcgaacaagaagcttgcggagaacatagaggccaaggaagaagcgtgcgtcgagaccgaagcggcgaacagcattctgagagcacagacaatggaactggccgatcgattgcgcttcttgaactccatccttgagatcgctgaagaggtcgaagggttatccgttgagattcccgagattccagatcctctcctcaagccctggcagattcctcatccgatacaaccgattatggccaccgcaaacatgtttctgcgttgatcattcctgaggattttactttaattagggttattcagtgcggtagtaactttctctgttatgtgtattatattactattagtgttatctgtctgcatcaaaagtatcgtgtggtcatcaatgcattgggttcctgagagagatgaatgtgaggtacagggtgttgatggctggtagtggcagtgtgtgtccctttgcgcgacttgtaatcattttttatggtggctgttttattttaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 152 - protein, 150 aa, Glycine max
MASPIQQQQRSTTTSSGSEGGDPHIIDERKRKRMLSNRESARRSRMRKQKQLEDLTDEVSRLQSANKKLAENIEAKEEACVETEAANSILRAQTMELADRLRFLNSILEIAEEVEGLSVEIPEIPDPLLKPWQIPHPIQPIMATANMFLR

SEQ ID NO: 153 - DNA, 952 bp, Glycine max
tcacaataaaatctatctgcaatatattgttatttttattttctgagaaatttgtgtctagttataagtgtctgggtcctggtcctgcctattgtgtcaattaaattgagaagggttgtattgtattgaatcatatatcgtatcatataaacatggcttgttcaagtggaacatcttcagggtcattatctctgcttcagaactctggttctgaggaagatttgcaggcgatgatggaagatcagagaaagaggaagagaatgatatcaaaccgcgaatctgcacgccgatctcgcatgaggaagcagaagcacttggacgatcttgtttcccaagtggctcagctcagaaaagagaaccaacaaatactcacaagcgtcaacatcaccacgcaacagtacttaagcgttgaggctgagaactcggtgcttagggctcaggtgggtgagttgagtcacaggttggagtctctgaacgagatcgttgacgtgttgaatgccaccaccactgtggcgggttttggagcagcagcatcgagcaccttcgttgagccaatgaataataataataatagcttcttcaacttcaacccgttgaatatggggtatctgaaccagcctattatggcttctgcagacatattgcagtattgattgagatgcttcatctctgagatttgatgaggatttcttcttcttcttcttctgggtttgagtctgtcgagaaattgtaatcactaccatatgatggtgataaggaataatattaataatgaatgtgtatcataaaaacgggtgggattgttaatgttaggtgctggttccgtaaatggggcatggggcatgggccattactgtaatttgtcaccctcctttcctatataataataataataataataataatactgacctctctatgttattattctcccaaaaaaaaaaaaaaaaaa

SEQ ID NO: 154 - protein, 182 aa, Glycine max
IEKGCIVLNHISYHINMACSSGTSSGSLSLLQNSGSEEDLQAMMEDQRKRKRMISNRESARRSRMRKQKHLDDLVSQVAQLRKENQQILTSVNITTQQYLSVEAENSVLRAQVGELSHRLESLNEIVDVLNATTTVAGFGAAASSTFVEPMNNNNNSFFNFNPLNMGYLNQPIMASADILQY

SEQ ID NO: 155 - DNA, 792 bp, Triticum aestivum
gcacgagtttctctctgagatagtctttcgaatccatctctagggctcctgtttctccccatcctccccccaccccaccccccaccaaacagattcaatccgacaagacaagcatccatgtcgtcgtcacgccggagctcgagccccgacagcaacgacacgacggacgagcgcaagcggaagcggatgctgtccaacagggagtcggcgcggcggtcgcgcgcgcggaagcagcagcggctggaggagctggtggcggaggtggcccgcctgcaggcggagaacgcggcgacgcaggcccgcaccgcggcgctggagcgcgacctgggcagggtggacggcgacaacgcggtgctgcgcgcccgccacgccgagctggccggccgcctgcagtcgctgggcggcgtcctcgaggtgctccagatggccggcgccgccgtcgacatcccggagatggtcaccgacgaccccatgctccgcccctggcagccgtccttccccccgatgcagcccatcgggttctgagaatctgagcctcagccggcgggagagagccaatttctgtcgtcgtgccgctgtctatctcgtattggtatatctattcataaatcatccttgtcatggtttgctcttcttgtcagtgttataaatttgcttcttgttagtgttataaatttggccatcggaaaggatgtgtttgtagttgtaatatcttgtttggagttgtaatatcttatcttgcttatgaaatcgaatatgcctatatatatataaaaaaaaaaaaaaaaaaaa

SEQ ID NO: 156 - protein, 168 aa, Triticum aestivum
DSLSNPSLGLLFLPILPPPHPPPNRFNPTRQASMSSSRRSSSPDSNDTTDERKRKRMLSNRESARRSRARKQQRLEELVAEVARLQAENAATQARTAALERDLGRVDGDNAVLRARHAELAGRLQSLGGVLEVLQMAGAAVDIPEMVTDDPMLRPWQPSFPPMQPIGF

SEQ ID NO: 157 - DNA, 1249 bp, Zea mays
gcacgagaggcaacaaactcgaacgcgcgcggtagtggagccgagatgcagggaggggcgacggccaagcagcaggcgcgagacggtgaccgcggcgcggcgaagacgccgacgacggaggggaagggcgacgccgccggcgccaaggctagcgccgacgtggcgaagggcgacgccgccgtcgccaaggctgctggggacgacgtcgtcgtagggaagggcgacgcaggcaacaaggccggcgccggggccatgcaccacggcctgtcggccgtggaggcgaaggactcccagaccatcgtcgcgctgcagtcgccggtgaccgtcatgcgccccgtccgcggcgacctcgaggagcacctccccaagccatatctggcgcgagccctggtggcgccggacatctaccaccccgacggcaccgcggccgacgagcacggccaccaccacatgagcgtgttgcagcagcacgtcgccttcttcgaccgcgacgacaacggcatcatctacccttgggagacgtactccggatgccgtgcgcttgggttcaacatgatcctgtctctcttgatcgctcttgtcgtgaacgggaccatgagctatgccacgctgcctgggtggctgccgtcccctctgttcccgatctacgtccacaacatccacaagagcaagcatggcagtgactctgggacctacgacaacgagggcaggttcatgccagtgaacttcgagaacctgttcagcaagtacgcgcgcacttccccggacaggctcacctacagggagctctggtcgatgacggaggggttccgcgacgccttcgacctctacggctggattgcggcgaagctggagtggacgatcctgtacgtgctggcgcgggacgacgaggggtacctgtcgcgggaggccatgcggcgcgtgtacgacggcagcctcttcgagtacgtggagaggcagcgcgcgcagcacgccaagatgtcctagctagagggaagaggatgcgacgtgggcacgtggcctcgatcgcgcgtgaatgaaatggaagccaagtgaacctgtctcggctggtatgtagatagtgagaagggtgtcggccggaaaacaagcagccgtgtgtactactccctcagctcccatcaataacgcagagttcgccggaccggcacctccccaaaaaaaaaaaaaaaaaaaaaaaaaaaaaaaaaaaaaaaaaaaaaaaaaaaaaaaaaaaaaaaaaaaaaaaaaa

SEQ ID NO: 158 - protein, 244 aa, Zea mays
MHHGLSAWKAKDSQTIVALQSPVTVMRPVRGDLEEHLPKPYLARALVAPDIYHPDGTAADEHGHHHMSVLQQHVAFFDRDDNGIIYPWETYSGCRALGFNMILSLLIALVVNGTMSYATLPGWLPSPLFPIYVHNIHKSKHGSDSGTYDNEGRFMPSELREPVQQVRAHSPDRLTYRELWSMTEGFRDAFDLYGWIAAKLEWTILYVLARDDEGYLSREAMRRVYDGSLFEYVERQRAQHAKMS

SEQ ID NO: 159 - DNA, 1364 bp, Zea mays
  unsure (1341): n = A, C, G, or T
  unsure (1359)..(1360): n = A, C, G, or T
ctcgtgccgaattcggcacgaggatagctagcctttgatttctcacttcaatctgacgaagtgcacacctaggcaacaaactcgaacgcgcgcggtagtggagccgagatgcagggaggggcgacggccaagcagcaggcgcgagacggtgaccgcggcgcggcgaagacgccgacgacggaggggaagggcgacgccgccggcgccaaggctagcgccgacgtggcgaagggcgacgccgccgtcgccaaggctgctgggggacgacgtcgtcgtagggaagggcgacgcaggcaacaaggccggcgccggggccatgcaccacggcctgtcggccgtggaggcgaaggactcccagaccatcgtcgcgctgcagtcgccggtgaccgtcatgcgccccgtccgcggcgacctcgaggagcacctccccaagccatatctggcgcgagccctggtggcgccggacatctaccaccccgacggcaccgcggccgacgagcacggccaccaccacatgagcgtgttgcagcagcacgtcgccttcttcgaccgcgacgacaacggcatcatctacccttgggagacgtactccggatgccgtgcgcttgggttcaacatgatcctgtctctcttgatcgctcttgtcgtgaacgggaccatgagctatgccacgctgcctgggtggctgccgtcccctctgttcccgatctacgtccacaacatccacaagagcaagcatggcagtgactctgggacctacgacaacgagggcaggttcatgccagtgaacttcgagaacctgttcagcaagtacgcgcgcacttccccggacaggctcacctacagggagctctggtcgatgacggaggggttccgcgacgccttcgacctctacggctggattgcggcgaagctggagtggacgatcctgtacgtgctggcgcgggacgacgaggggtacctgtcgcgggaggccatgcggcgcgtgtacgacggcagcctcttcgagtacgtggagaggcagcgcgcgcagcacgccaagatgtcctagctagagggaagaggatgcgacgtgggcacgtggcctcgatcgcgcgtgaatgaaatggaagccaagtgaacctgtctcggctggtatgtagatagtgagaagggtgtcggccggaaaacaagcagccgtgtgtactactccctcagctcccatcaataacgcagagttcgccggaccggcacctccccatctttgctacttcaacctggtttttcgcgcggtttatgtggctgtctgaagcgagacatgaatttgcgtattgtttaattttacaaaactactgaaatgancaaaatggcctagaatannaaaa

SEQ ID NO: 160 - protein, 244 aa, Zea mays
MHHGLSAVEAKDSQTIVALQSPVTVMRPVRGDLEEHLPKPYLARALVAPDIYHPDGTAADEHGHHHMSVLQQHVAFFDRDDNGIIYPWETYSGCRALGFNMILSLLIALVVNGTMSYATLPGWLPSPLFPIYVHNIHKSKHGSDSGTYDNEGRFMPVNFENLFSKYARTSPDRLTYRELWSMTEGFRDAFDLYGWIAAKLEWTILYVLARDDEGYLSREAMRRVYDGSLFEYVERQRAQHAKMS

SEQ ID NO: 161 - DNA, 1022 bp, Zea mays
ccgcacaataatctgcgctgcgcggaagaagggaaggggaaaagcagttaagcttgagcgcgcgcgacagggtcaagtcgagggccggggaatcgccggagaatggaggtgggcagggctccgcgacgacgggtgtccccagcggcggcggcggcggctgtgccttcgctgcttctgttcgccgttctattcgcgggccgggcggcggcgttcggccacctgcaaggcgccggcgcgacggcgctgtacaagcacgcgtcgttcttcgaccgcgatggcgacggcgtcgtctccttctcggagacgtacggcgcgtttcgggcactcgggtttggattcggcctgtccagcgtcagcgctgccctcatcaatggcgcccttggtagcaagtgcagacctcaaaatgcaacgtcatcgaagttggatatctacatagaggacatccagaaagggaaacatggaagcgattcagggtcatacgacgccgaaggaaggtttgttcctgacaagttcgaagagatattcgccaagcacgccaagactgtcccagacgccctgacgtcggacgagatcgaccagctgctgcaggcgaacagagagcccggggactacagcggatggcttggcgctgaagcggagtggaagaccctctacagcctcggcaaggacaaggacgccctcctccgcaaggacgtcgcgagaagcgtttacgacgggacactgttccacatgctcgcgcccaactggaaatctcccgacgaggaggaggaacaggaactaagcgtgatccgggagagctgaaccgagaggtacaagcaaagtctgggttgagagataaggactcctgggaccctctgaacatgctgtcaagcaacatgtactactagcggtgtgaacgggtggtgttgaacactcttttcatatcacatccataaaaaaaggtgttgaacagatatttcaatgtacattatcataaaataagataaattcataattcaaataaaaatattctgtgtcttacc

SEQ ID NO: 162 - protein, 247 aa, Zea mays
ARATGSSRGPGNRRRMEVGRAPRRRVSPAAAAAAVPSLLLFAVLFAGRAAAFGHLQGAGATALYKHASFFDRDGDGVVSFSETYGAFRALGFGFGLSSVSAALINGALGSKCRPQNATSSKLDIYIEDIQKGKHGSDSGSYDAEGRFVPDKFEEIFAKHAKTVPDALTSDEIDQLLQANREPGDYSGWLGAEAEWKTLYSLGKDKDALLRKDVARSVYDGTLFHMLAPNWKSPDEEEEQELSVIRES

SEQ ID NO: 163 - DNA, 757 bp, Zea mays
  unsure (7): n = A, C, G, or T
  unsure (31): n = A, C, G, or T
  unsure (44): n = A, C, G, or T
cggacgntggacgtgcatgccttactctggncgtcgcgcgctgnaaggagaacgagaagcctgcgcctttcaagttccccatctacgtgaagaacatccacaggggcaagcacggcagcgattcgggcgtctacgattccaacggaagatttgtacctgaaaagtttgaggagattttcaagaagtatgcccacacgaggcctgatgcccttacaggcaaagagctacaggagatgatgaaagcaaacagagaacccaaggacttgaaaggatggctgggtggcttcacagagtggaaggtgctgtactccctgtgcaaagacaaggacgggtttctccacaaagacactgtcagggcggtctacgatggcagcctgtttgaaaggttggagcaagagaggaactcaaagaaagagtcgagtaagaagaaatgatgagaaatccagacgctcttatgtggacgagtttgcaagtcacgctgtgcgtgtggttgggtactatcataatttgatttattctatatgtttgtcgattcatataacgatattgcaagtatttgtcgaacgtgtttgaattagcaagacatatagctgtgagctttgatagcctcccatatttttttcagttcatattttacattaacgtttttgtgcggtgcttgaaaatatttcgagcgtgttgttgttttttttcagttgtcttagtcatggactcatggtagattgctaccgcttttaaggctattgtttgtctagtt

SEQ ID NO: 164 - protein, 143 aa, Zea mays
  UNSURE (2): Xaa = any amino acid
  UNSURE (10): Xaa = any amino acid
  UNSURE (14): Xaa = any amino acid
DXGRACLTLXVARXKENEKPAPFKFPIYVKNIHRGKHGSDSGVYDSNGRFVPEKFEEIFKKYAHTRPDALTGKELQEMMKANREPKDLKGWLGGFTEWKVLYSLCKDKDGFLHKDTVRAVYDGSLFERLEQERNSKKESSKKK

SEQ ID NO: 165 - DNA, 912 bp, Zea mays
gcacgagatttttgtggaatttcaatgcctgccgctgctgtccatgtgtagttcgcgtgccctgtggcctgtgcactgctgccgctttaaagcagaggggtctctctcgtcgtctgagtcgtctcgccgcctttctctatctcccgatccgtcgttcatcagagtcgtaacgcgctcgttcccctcctagtcgctctcccaagtcccaaccccggttcctttggtctgcgcgaccgagcatggcgtcgccgtcgccgtcgcccgccgtctcgtctctggagacggaggcgccccaggctaccgtcacgagggagcgcaggctcaaccccgacctgcaggagcaccttcccaagccatatctcgcgagggctatggtggcggtggacccggaccatccgaccgggaccgaggggcgcgacccccgcggcatgagcgtgcttcagcagcacgtggctttcttcgaccgcaacggcgacggcgtcgtctacccctgggagactttcaaaggcatgcgagcaatagggtgtgggttctttacatccctcgtcatctcgttcctcatcaacctcgtcatgagttatcccactcagccgggatggctaccctcccttttgctctccgttcatgtaaagaacattcataaggctaaacacgggagtgactccgaaacgtatgacactgaagggaggtttgacccatcaaaattcgacgctatatttagcaagtatggtcgtactcatccagatgcgttgacaaaagatgagatgaattcgatgcttaaggcaaaccgcaatatatatgatttcctcggctggatcgctgctatcggtgaatggcatctactctacagcgtggcaaaggacaaagatggcctgttgcagcgagaaattgtccggcgcctgttcgatgcga

SEQ ID NO: 166 - protein, 246 aa, Zea mays
RARSPPSRSPKSQPRFLWSARPSMASPSPSPAVSSLETEAPQATVTRERRLNPDLQEHLPKPYLARAMVAVDPDHPTGTEGRDPRGMSVLQQHVAFFDRNGDGVVYPWETFKGMRAIGCGFFTSLVISFLINLVMSYPTQPGWLPSLLLSVHVKNIHKAKHGSDSETYDTEGRFDPSKFDAIFSKYGRTHPDALTKDEMNSMLKANRNIYDFLGWIAAIGEWHLLYSVAKDKDGLLQREIVRRLFD

SEQ ID NO: 167 - DNA, 516 bp, Zea mays
gcacgaggggcaaacatggaagcgacacaggcgcctacgacgctcaaggaaggttcgttcccgcgaagctggacgagatgttcaccaagcacgccaagaccgtaccgaacgccctgacgaaagacgagctcgacgagatgctcaaggataaccgggagaagatggacgtcgcaggatggctgggagccaagtcggagtgggagatgctgtacaagctggccaaggacaaggacggccgcctgcccaaggacaccgtcagggccgtgtacgacggatccctcttttaccagctggcggcgcaggcgaagaagggctgattcgtttacgttaatttcagtaatcaataacaagcaacgtttttttttttgtcgtttctgaatgcttgcctgtgtggctgtgtaagaaagcgagtgggtcggactcaatggcaggcaacggttttgttttttttattattattttaacggatcggttctactaagtgtggcatggcaatggcatgtatgtgtagggctc

SEQ ID NO: 168 - protein, 103 aa, Zea mays
RGKHGSDTGAYDAQGRFVPAKLDEMFTKHAKTVPNALTKDELDEMLKDNREKMDVAGWLGAKSEWEMLYKLAKDKDGRLPKDTVRAVYDGSLFYQLAAQAKKG

SEQ ID NO: 169 - DNA, 882 bp, Zea mays
ccacgcgtccgcagcgcatgactttgtatctgcaactcgtttcgactagcctgcacgccgggagccctcgtctcgcccttctccacctccgaagatcctgcgagttcaacccgcgagtgagcatgtcgtcctactccccgccgccgccgccgccgcgggaccagtccatggacaccgaggcacccaacgcgcccatcaccagggagcggaggctcaaccccgatctgcaggagcagctccccaagccatatctcgcgagagctctcgaggcggtggacccgagccacccgcaggggaccaaggggcgcgacccccgcggcatgagcgtgcttcagcagcacgccgccttcttcgaccgcaatggcgacggcgtcatctacccctgggagacgtttcaaggactgcgagcgataggatgtggactcactgtatcattcgcgttctccatactgatcaacctcttcctcagttatcccactcagccggttggccgctgccggtgaatggctcttactctacagcttggcgaaagacaaggatggcctcttgcagcgcgaaactgtccgtggtctatttgatgggagcctatttgagcgactggaagacgacaacaacaagaagaaatcgtcctgaatgctgagcagccttgtacagctcagggaagtgctgtcagtacaaaactaccagatataccattggtcgtgttcaaataacaaatgcttcggctttgttcatccgtcattaactatgagtgctgggatttgtttgtatgtgtgtcgtgctaccagtttcttctcctgtcgtctcacacaggtactgtattacgcatgtgttttctagtgtccgtgcggaagctgtattataagctgaaatatgtgcgtt

SEQ ID NO: 170 - protein, 126 aa, Zea mays
MSSYSPPPPPPRDQSMDTEAPNAPITRERRLNPDLQEQLPKPYLARALEAVDPSHPQGTKGRDPRGMSVLQQHAAFFDRNGDGVIYPWETFQGLRAIGCGLTVSFAFSILINLFLSYPTQPVGRCR

SEQ ID NO: 171 - DNA, 838 bp, Zea mays
  unsure (738): n = A, C, G, or T
  unsure (814): n = A, C, G, or T
ccacgcgtccgggggccccgtggggagtgggggcacgggcacccgcacaagctgcgctgccagtgccagcgctcacacgaacgccgagacccgagaggagcaaacagccaaaaagaacggaaaggagagagcagttaccttgcgcgcgaagactcgaaggggaatctccggaggatggaggtgggcaggactccgcggcgacgggcgtccccagcggcggcggctgtgccttcgctgcttctgttcgccgtgctattcgtgggtgaagtgggccgggcggcggcagcgttgggcggcccggggccggcgctatacaagcacgcgtcgttcttcgaccgcgacggcgacggcgtcgtctccttcgcggagacgtacggcgcgtttcgggccctcgggtttggactcggcctgtccagcgccagcgccgccttcatcaatggcgcccttggcagcaagtgcagacctcaaaacgcgacgtcgtcgaaactggacatctacatagaggacatccggagagggaagcacgggagcgactccggctcgtacgacgcccaaggaaggttcgttcccgagaagttcgaggagatattcgccaggcacgcgaggacagtccccgacgccctgacctcggacgagatcgaccagctgctccaagcgaacagagagcccggggactacagcgggtgggctggcgcggaagcggagtggaagatcctgtacagtctcggcaaggacggngacggcctcctccgcaaggacgtcgcgaggagcgtctacgacgggacactgttccaccggctcgcgcccagatggnaatctcccgacagggagagaagct

SEQ ID NO: 172 - protein, 279 aa, Zea mays
  UNSURE (272): Xaa = any amino acid
PRVRGPRGEWGHGHPHKLRCQCQRSHERRDPRGANSQKERKGESSYLAREDSKGNLRRMEVGRTPRRRASPAAAAVPSLLLFAVLFVGEVGRAAAALGGPGPALYKHASFFDRDGDGVVSFAETYGAFRALGFGLGLSSASAAFINGALGSKCRPQNATSSKLDIYIEDIRRGKHGSDSGSYDAQGRFVPEKFEEIFARHARTVPDALTSDEIDQLLQANREPGDYSGWAGAEAEWKILYSLGKDGDGLLRKDVARSVYDGTLFHRLAPRWXSPDRERS

SEQ ID NO: 173 - DNA, 413 bp, Oryza sativa
  unsure (274): n = A, C, G, or T
  unsure (305): n = A, C, G, or T
  unsure (348): n = A, C, G, or T
  unsure (358): n = A, C, G, or T
  unsure (360): n = A, C, G, or T
  unsure (367): n = A, C, G, or T
  unsure (375): n = A, C, G, or T
  unsure (382): n = A, C, G, or T
  unsure (405): n = A, C, G, or T
ctacgaagggtgccgtgcgcttgggttcaacatgatcatgtccttcctcattgctctggtcgtgaacgtgtccatgagctaccccacgctgcctggctggctgccgtccccgttcttcccgatctacatccacaacatccacaggagtaagcacgggagtgactctgggacctacgataacgagggccggttcatgccggtgaacttcgagaacatcttcagcaagtacgcgcgcacgtcccctgacaggctcacctacagggaggtgtggcanatgaccgaggggaaccgcgaagtgctcgatntcttcggatggttcgcggcgaagctggagtggaccattctgtncgtgctggcnanggaccangaaaggtncctggcnaaggaaggcaaccggggcaagtncgaacggg

SEQ ID NO: 174 - protein, 132 aa, Oryza sativa
  UNSURE (91): Xaa = any amino acid
  UNSURE (102): Xaa = any amino acid
  UNSURE (116): Xaa = any amino acid
  UNSURE (120): Xaa = any amino acid
  UNSURE (122): Xaa = any amino acid
  UNSURE (125): Xaa = any amino acid
YEGCRALGFNMIMSFLIALVVNVSMSYPTLPGWLPSPFFPIYIHNIHRSKHGSDSGTYDNEGRFMPVNFENIFSKYARTSPDRLTYREVWXMTEGNREVLDXFGWFAAKLEWTILXVLAXDXERXLAKEGNR

SEQ ID NO: 175 - DNA, 1003 bp, Oryza sativa
gcacgaggttcgatccccaactaagagcgttttgttttcgtttttcttctgttcgttcgttctttcgatctgcagatcctacaaactcgccccccgaataaccatggcgtcgtcttcgtcgtcgtcgccgccgtcgtctgacccgtccttggagacggtagcgccgcacgcggctgttacgggggagcggaagctcaaccccaacctgcaggagcagcttcccaagccatatctcgcgagggctctcgcggcggtggacccgagccacccgcaggggacccgtgggcgcgacgcccgcggcatgagcgtgctccagcagcacgccgcgttcttcgaccgcaacggcgacggcatcatctacccctgggagaccttccaagggctgagagcgataggttgcgggtatcccgtgtcgattgctggtgccatactcatcaacctcgtcctcagctatcctactcaaccggggtggatgccttctcctctgttttccatccatataaagaacattcacaagggtaagcatgggagtgactctgaagcatatgatactgaagggaggtttgatccatcgaaatttgatgctatattcagcaagtatggcagaactcatccaaatgctttgacaaaagatgagctgaactcgatgattaaagcaaaccgcaatatgtatgatttcattggctggattactagcgctggtgaatggatgctactgtacagcgtggccaaggataaagaagggctgttgcaacgagaaactgttagaggcgccttcgatggcagcctgtttgagcgacttcaggacagcaagaaatctgcttgaatatagcaatgagctgtgctgctcgaagaaagcgttgacagtaaagaatctaataagattagaaaaaaaaagggtctttgctttgtgtaattcaaatgaaaaatgttaattaccccatgacagtatttatgatgtttgcaatgatcaccacctcatgataaaaaaaaaaaaaaaaaa

SEQ ID NO: 176 - protein, 274 aa, Oryza sativa
HEVRSPTKSVLFSFFFCSFVLSICRSYKLAPRITMASSSSSSPPSSDPSLETVAPHAAVTGERKLNPNLQEQLPKPYLARALAAVDPSHPQGTRGRDARGMSVLQQHAAFFDRNGDGIIYPWETFQGLRAIGCGYPVSIAGAILINLVLSYPTQPGWMPSPLFSIHIKNIHKGKHGSDSEAYDTEGRFDPSKFDAIFSKYGRTHPNALTKDELNSMIKANRNMYDFIGWITSAGEWMLLYSVAKDKEGLLQRETVRGAFDGSLFERLQDSKKSA

SEQ ID NO: 177 - DNA, 444 bp, Oryza sativa
  unsure (239): n = A, C, G, or T
  unsure (256): n = A, C, G, or T
  unsure (308): n = A, C, G, or T
  unsure (323): n = A, C, G, or T
  unsure (328): n = A, C, G, or T
  unsure (332): n = A, C, G, or T
  unsure (341): n = A, C, G, or T
  unsure (353): n = A, C, G, or T
  unsure (355): n = A, C, G, or T
  unsure (389): n = A, C, G, or T
  unsure (394): n = A, C, G, or T
  unsure (397): n = A, C, G, or T
gtgcaggttcatgccggtgaacttcgagaacatcttcagcaagtacgcgcgcacgtcccctgacaggctcacctacagggaggtgtggcagatgaccgaggggaaccgcgaagtgctcgatctcttcggatggttcgcggcgaagctggagtggacgaccctgtacgtgctggcgagggacgaggaagggtacctggcgagggaggccatccggcgcatgtacgacgggaacctgttcnagtacgtggcgaagcanccgggagcaacacgctaaaatgtcctaaattaacttaattaactactggatnggtcctgttggtgtnaaatncaanccctgtganccaagggaaatncnaaccgtgctctgcctggcgggttaagtccggggntctcnccnggctcccgggtgaaaaaaaaaaaaaaaccaaaattccttcccgtccg

SEQ ID NO: 178 - protein, 90 aa, Oryza sativa
  UNSURE (80): Xaa = any amino acid
  UNSURE (85): Xaa = any amino acid
CRFMPVNFENIFSKYARTSPDRLTYREVWQMTEGNREVLDLFGWFAAKLEWTTLYVLARDEEGYLAREAIRRMYDGNLFXYVAKXPGATR

SEQ ID NO: 179 - DNA, 675 bp, Oryza sativa
  unsure (650): n = A, C, G, or T
caccatcagccaaagtgccaaacgatcgatcgatctctgcagtctgcagattagcccaccacctccagcatcgggtccacgaatgcacaccctgtcaactccactccacccgcttttctttccctctccccgccaccttcacatctcaacctttcctctccctctctctctctctctctgatctcgtcgttcccatggcctccaaacccgcggacgttacggctacaggtggcggcggcgtcgccgtcgtccgtgacaacaacaacaacgccggcggcggcgaggcggaggtgtaccgctccgagctgacgccgctgcagaagcacgtcgccttcttcgaccgcaacaaggacggcatcatctacccctccgagacctaccaagggttccgcgcaatcggggcaggagtcgtgctgtccgccgtcggcgccgtgttcatcaatggcggacttgggcccaagacgataccggagaacaccaagactggtctcaagttacccatatacgtcaagaacatccacaaaggcaagcatggaagcgattcaggcgtgtatgatgcgaatggaaggtttgtcccaaaaaagttcgaggaaatattcaagaagcatgctcacaccaggcctgatgccctaacagacaaagagctgaangaattgctccaatcaaacagggagc

SEQ ID NO: 180 - protein, 224 aa, Oryza sativa
  UNSURE (216): Xaa = any amino acid
PSAKVPNDRSISAVCRLAHHLQHRVHECTPCQLHSTRFSFPLPATFTSQPFLSLSLSLSDLVVPMASKPADVTATGGGGVAVVRDNNNNAGGGEAEVYRSELTPLQKHVAFFDRNKDGIIYPSETYQGFRAIGAGVVLSAVGAVFINGGLGPKTIPENTKTGLKLPIYVKNIHKGKHGSDSGVYDANGRFVPKKFEEIFKKHAHTRPDALTDKELXELLQSNRE

SEQ ID NO: 181 - DNA, 520 bp, Glycine max
  unsure (270): n = A, C, G, or T
aattcattcaccaaaaagttcttcgccccttctttgtccccattctttctctttaatatactttgtccatattttcctctttctcttcctatcaaacatccatggcttccttgtcttctagtacaaaacagagcaataataaccaagaggttgatgagaaaccaataccacacgatcaaaacgttctgcaaaagcacgttgcgttcttcgacaggaaccacgatggcatcatatacccgtgggagactttccaaggatttcgagcaatangttgtgggtacttattatcgtccgttgctgctattttcatcaatggaggtctcagtcagaaaacccgcccgggaaagtttccttcaatactgctaccaattgaagttcaaaacatccatagaagcaagcatggaagtgactctggtgtctacgatagtgaaggaaggtttgttctttcaaaatttgaagaaattttcagcaagcatgctcgaacacacccaaattctttaacatctgatgaattgatggg

SEQ ID NO: 182 - protein, 139 aa, Glycine max
  UNSURE (57): Xaa = any amino acid
MASLSSSTKQSNNNQEVDEKPIPHDQNVLQKHVAFFDRNHDGIIYPWETFQGFRAIXCGYLLSSVAAIFINGGLSQKTRPGKFPSILLPIEVQNIHRSKHGSDSGVYDSEGRFVLSKFEEIFSKHARTHPNSLTSDELM

SEQ ID NO: 183 - DNA, 521 bp, Glycine max
  unsure (344): n = A, C, G, or T
  unsure (450): n = A, C, G, or T
  unsure (455): n = A, C, G, or T
  unsure (463): n = A, C, G, or T
  unsure (481): n = A, C, G, or T
  unsure (486): n = A, C, G, or T
  unsure (488): n = A, C, G, or T
  unsure (494): n = A, C, G, or T
  unsure (519): n = A, C, G, or T
atttgattccttagttcagcattctattattatatatggcttcttcaccttcctcagaaaacaaaaacctagagggagtagctggtggtgccggagagaaacccattccacttggtgagaacgttctgcagaagcatgctgcattctttgacttgaataaagatggtgtcatctacccatgggagacttttaaagggttgcgtgaaatcgggactggggttttgctgtccgttggaggtgctattttcatcaatgtgtttctcagtcagagtactcgtcccggaaagtttccatctatactttttccaattgaaattaaaaatatccaacgcggcaaacacggnagtgacactggagtctacgatactgaaggaagggttgtaccttcaaaatttgaagaaatttttaacaagcatgcacattcacatccaaatgccttggcaataggangaagnttaacggnatgttaaagggaatttgngaagncnaaaagnttttccaaaggaagggttggggaangg

SEQ ID NO: 184 - protein, 139 aa, Glycine max
MASSPSSENKNLEGVAGGAGEKPIPLGENNVLQKHAAFFDLNKDGVIYPWETFKGLREIGTGVLLSVGGAIFINVFLSQSTRPGKFPSILFPIEIKNIQRGKHGSDTGVYDTEGRVVPSKFEEIFNKHAHSHPNALAIG

SEQ ID NO: 185 - DNA, 528 bp, Glycine max
  unsure (378): n = A, C, G, or T
  unsure (517): n = A, C, G, or T
caaacacggcagtgacactggagtctacgatactgaaggaaggtttgtaccttcaaaatttgaagaaatttttaacaagcatgcacatacacatccaaatgctttgacatatgatgagttaacggagatgataaaggcaaatagagagcctaaagatttctcaggaaggattggtagtgtggttgaatggaaaattctttacaaacttgctaaagataagagtggattactgcagaaagaaacaatccgaggtgtttacgatggaagtttatttgaacaactgaaaaaacaacactcttcaggcaaagagaagtagtaatatttttcagacacgtatgtgaaaagaagaagttacttgtcgatctcagcaaaattggntatttttatgaatttatatgctagtaagttagtcacaatattcaaagtgtctgtttatttttatgttcatcaataatgtatatgtcaagtcaaacttatgtggcatctatcaaggttggattcatccgaaaagcacgtntacagtaaaat

SEQ ID NO: 186 - protein, 104 aa, Glycine max
KHGSDTGVYDTEGRFVPSKFEEIFNKHAHTHPNALTYDELTEMIKANREPKDFSGRIGSVVEWKILYKLAKDKSGLLQKETIRGVYDGSLFEQLKKQHSSGKEK

SEQ ID NO: 187 - DNA, 409 bp, Glycine max
  unsure (384): n = A, C, G, or T
cttatagcttcatcccaaaaagctcttttccttctaaatttgattccttagttcagcattctattattatatatggcttcttcaccttcctcagaaaacaaaaacctagagggagtagctggtggtgccggagagaaacccattccacttggtgagaacgttctgcagaagcatgctgcattctttgacttgaataaagatggtgtcatctacccatgggagacttttaaagggttgcgtgaaatcgggactggggttttgctgtccgttggaggtgctattttcatcaatgtgtttctcaagtcaagagtactccgtcccggaaagtttccaaccaaactttttccaattgaaattaaaaatatccaacgcgggaaacacggnagtgacactgggagtctacgatact

SEQ ID NO: 188 - protein, 112 aa, Glycine max
MASSPSSENKNLEGVAGGAGEKPIPLGENVLQKHAAFFDLNKDGVIYPWETFKGLREIGTGVLLSVGGAIFINVFLKSRVLRPGKFPTKLFPIEIKNIQRGKHGSDTGSLRY

SEQ ID NO: 189 - DNA, 904 bp, Glycine max
gcacgagctcgaacccagaaaaactcttctctcgatccttctgaatttgcggatccagcattctatatccatatggcttcctcagaaagcacaaaacaagagggagtagttggtggtattggggagaaactcattccacttcatgaaaatgttctgcagaagcatgctgcattctttgacaagaatcacgatggtgttatttacccatgggagacatttcaaggcttacgtgaaattggaaatgggatcttgtcgtccgttggactttctctattcatcaatttggctcttagtcaaaccactcgaccaggaaagtttccatctctacttttcccaatagaaattaagaatatccaactcggcaaacacggcagtgacactggagcctatgatactgaaggaaggtttgttccttcaaaatttgaaggaattttcacaaaacattcacatactcatccaaatgctttaacatatgatgagctaaaggagatgctaaaagcaaatagagagcccaaagatttcaaaggaaggattggtggcttggttgaatggaaagtcctttacaaacttgccaaagacaagaatggcttactacagaaggaaacaatccgaagtgtttatgatggaagcttgtttgaaatgttgaaaaaggaaaattctgcacgcaaaaagaattaattcaatctttagttagtgatctattttttctttaatatatatagacacaataatgtgtaaaaggaagaagcttacttgttcaagggtggcgaagttgatttttaagaatatatagatggccataatacattagaatttcccaatttagcttgtatttgggtttatttgtttaagttaaataatgtatctaagttattaatttatcgtaaaaaaaaaaaaaaaaaaa

SEQ ID NO: 190 - protein, 225 aa, Glycine max
ARARTQKNSSLDPSEFADPAFYIHMASSESTKQEGVVGGIGEKLIPLHENVLQKHAAFFDKNHDGVIYPWETFQGLREIGNGILSSVGLSLFINLALSQTTRPGKFPSLLFPIEIKNIQLGKHGSDTGAYDTEGRFVPSKFEGIFTKHSHTHPNALTYDELKEMLKANREPKDFKGRIGGLVEWKVLYKLAKDKNGLLQKETIRSVYDGSLFEMLKKENSARKKN

SEQ ID NO: 191 - DNA, 483 bp, Glycine max
  unsure (367): n = A, C, G, or T
  unsure (417): n = A, C, G, or T
  unsure (434): n = A, C, G, or T
  unsure (475): n = A, C, G, or T
gtttccttcaatactgctaccaattgaagttcaaaacatccatagaagcaagcatggaagtgactctggtgtctacgatagtgaaggaaggtttgttctttcaaaatttgaagaaattttcagcaagcatgctcgaacacacccaaattctttaacatctgatgaattgatggggatgcttgtggcaaatagagttcctaaggattacgctggatggcttgctagctacacggagtgaagatcctatatgttcttggcaaagacaaggatggtttactgcacaaagagactattcgagctgtttatgatggaagcctctttgaaaaaatggaaaaggaacactcagacaagaaagcgaaataaatanagttgacatgaattataaagtgggaatgcgtctttgtgattcttgttgantgccttgaagtgtattntggtgaattccatggtgatgacttagtacgataatgttatnaatgttat

SEQ ID NO: 192 - protein, 78 aa, Glycine max
FPSILLPIEVQNIHRSKHGSDSGVYDSEGRFVLSKFEEIFSKHARTHPNSLTSDELMGMLVANRVPKDYAGWLASYTE

SEQ ID NO: 193 - DNA, 545 bp, Triticum aestivum
  unsure (453): n = A, C, G, or T
  unsure (494): n = A, C, G, or T
gcacagtgtgatacgcagagatagcgatcgagccgagcgccatggccgaggaggcaacaagggcggtcagggaagaagagctgtcgccggtggcggagggggcgcccgtgacggcccggcggcccgtccgagcggacctggagaagcgcatcccgaagccctacctggcccgagccctggtggcgccggacgtgtaccatcccggagggagcaaggagggcgggcaccagcaccgccagaggagcgtgctgcagcagcacgtcgccttcttcgacatggatggcgacggcgtcatctatccatgggaaacttaccaaggactgagggcattgggcttcaacatgatcgtctccatcctcatcgcaataggcatacatactaccctgagctacacaactctgcatagctgggtgccatctctccttttccaatctacatcgacaacatccacanggccaaagcatgggaacgacaccgcgacttatgactccganggaaagtacatgcccggtgaacttcaagaacatattcagcaagaacgcctc

SEQ ID NO: 194 - protein, 168 aa, Triticum aestivum
  UNSURE (138): Xaa = any amino acid
  UNSURE (151): Xaa = any amino acid
MAEEATRAVREEELSPVAEGAPVTARRPVRADLEKRIPKPYLARALVAPDVYHPGGSKEGGHQHRQRSVLQQHVAFFDMDGDGVIYPWETYQGLRALGFNMIVSILIAIGIHTTLSYTTLHSWVPSLLFQSTSTTSTXPKHGNDTATYDSXGKYMPGELQEHIQQERL

SEQ ID NO: 195 - DNA, 655 bp, Triticum aestivum
  unsure (419): n = A, C, G, or T
  unsure (491): n = A, C, G, or T
  unsure (509): n = A, C, G, or T
  unsure (524): n = A, C, G, or T
  unsure (535): n = A, C, G, or T
  unsure (541): n = A, C, G, or T
  unsure (550): n = A, C, G, or T
  unsure (563): n = A, C, G, or T
  unsure (567): n = A, C, G, or T
  unsure (571): n = A, C, G, or T
  unsure (581): n = A, C, G, or T
  unsure (584): n = A, C, G, or T
  unsure (589): n = A, C, G, or T
  unsure (594): n = A, C, G, or T
  unsure (615): n = A, C, G, or T
  unsure (631): n = A, C, G, or T
  unsure (641)..(642): n = A, C, G, or T
  unsure (646): n = A, C, G, or T
  unsure (652): n = A, C, G, or T
gatccatccgcaacgcacggtgtgatacagagagagcgatcgagccgagcgtcatggcggaggaggcaagggcggtcagggaagaagagctgtcgccggtggcggaggcggcgcccgtgacggcccggcgacccgtccgagcggacctggagaagcacatcccgaagccctacctggcccgagccctggtggcgccggacgtgtaccatcccggagggagcaaggagggcgggcaccagcaccgccagaggagcgtgctgcagcaacacgtcgccttcttcgacatggatggcgacggcgtcatctatccatgggaaacttaccaaggactgagggcactgggcttcaacatgatcgtctccgtcgtcttcgcaatggcattcatgctagcctcaagctacacaactctgcataactgnggtacatctctgctgttcccgatctacatcgacaacatccacaagggcaagcatggcaacgacaacgcgacntatgcaacgagggaaagnacataccggtgaacnttcagaacatnttcaanaaagaacgnccgctctcgcggntaantcanaatcccgganatntggtnattgncgagggcaacgggaagcaacnttcaattcgttggtgnaacaaggggnntgtntgtgtnatc

SEQ ID NO: 196 - protein, 166 aa, Triticum aestivum
  UNSURE (139): Xaa = any amino acid
SIRNARCDTERAIEPSVMAEEARAVREEELSPVAEAAPVTARRPVRADLEKHIPKPYLARALVAPDVYHPGGSKEGGHQHRQRSVLQQHVAFFDMDGDGVIYPWETYQGLRALGFNMIVSVVFAMAFMLASSYTTLHNXGTSLLFPIYIDNIHKGKHGNDNATYAT

SEQ ID NO: 197 - DNA, 1157 bp, Triticum aestivum
gcacgagggttggattccctctctctctctctcagcagcactgctctgaagctctcttcttctgggccggggttcactcacggactcacagtaacccacagttcacagattcattcgcttgttcgatctgcagatcctgcaagctcggctcgtcgcgagtaaccgccatgtcgtcgtcgtcgtccgatccgtcgctggcgaccgaggcgccccaggcggccgtcaccagcgagcgcaagctcaaccgcgacctgcaggagcagctcgccaagccatatctggccagagcaatggcggcggttgacccgagccacccggagggcagcaaggggagggacaccaagggcatgagcgtgctccagcagcacgccgccttcttcgaccgcaacggcgacggggtcatctacccatgggagaccttccagagcctgcgagcaatcgggcttgggtcgccttcagccttcggaacatccatactcctccacctcgtcctcacttatcctactcaaccgggatggatgccttcccctctgctgtcgatccatataaagaacatccacaggggcaagcacgggagcgattctgagacgtatgacacagaagggaggtttgaaccagcgaaattcgatgctatattcagcaagtttggcaaaactcggccaaatgctttgtcagaagatgagattaacgccatgcttaaatacaaccgcaatatgtatgatttcctgggctgggccgcggccaacctcgaatggaagttgctgcacaaggtggcaaaggataacgaaggctttttgcagcgagaaatcgtgcggggcgccttcgatggcagcctgttcgagcgtctgcaggaaagcaagaaatctacctgaatgtggcagtgagcctcgtctctaaaatatctgcacttgaaatttgaaaagcctccctgcattgtagtttgagttgtgtacgtcaaataagaagtgtttggcccgtctgcggcggcctaaacattttcatttgcattgttattttgaactggaatttgtatttttattggtagcgcacagaaggtgtacagtggaacttgtaatgtgcactcgtgaatcatcattacctcgcataatataggcgtgtctctttcaaaaaaaaaaaaaaaaaaaaaaaaaaaaaaa

SEQ ID NO: 198 - protein, 289 aa, Triticum aestivum
TRVGFPLSLSQQHCSEALFFWAGVHSRTHSNPQFTDSFACSICRSCKLGSSRVTAMSSSSSDPSLATEAPQAAVTSERKLNRDLQEQLAKPYLARAMAAVDPSHPEGSKGRDTKGMSVLQQHAAFFDRNGDGVIYPWETFQSLRAIGLGSPSAFGTSILLHLVLTYPTQPGWMPSPLLSIHIKNIHRGKHGSDSETYDTEGRFEPAKFDAIFSKFGKTRPNALSEDEINAMLKYNRNMYDFLGWAAANLEWKLLHKVAKDNEGFLQREIVRGAFDGSLFERLQESKKST

SEQ ID NO: 199 - DNA, 1612 bp, Zea mays
gcacgagataaacaaaaaccagtcctttgttcttcttcccccggcacgcccagcgccagtcaccaaccttccactccctccctccgtcgccatggcgcgcaagaagatccgggagtacgactccaagcgcctcctcagggagcacctcaagcgcctcgccggcatcgacctcaccatcctctccgcccagatcacgcaatcaacggacttcgcggagcttgtgagccagcagccatggctgtcaaccatgaagctagtggtgaagcctgatatgctgttcgggaagcgtgggaagagcggcctcgtggctctcaacttggatttcaatcaagtcaaggagtttgtcaaggagcggctgggggttgaggttgagatgggtggctgcaaggctccaatcacgaccttcatcgtcgagccatttgtgccacatgatcaagagtactacctttcgattgtctcagagaggttgggcagcaccatcagcttctcagagtgtggagggattgagattgaggagaactgggacaaggttaagactattttccttcctactgagaagccaatgacgtctgattcatgtgctcctttgattgcaacccttccattggaggcacgcggaaaaattggtgacttcattaaaggagtgtttgccgtcttcctagacttggatttctcatttcttgagatgaatccgttcaccatggtcaatggggagccatatcctctggacatgagaggagaactagatgacacagcagctttcaagaacttcaagaagtggggaggtatagaatttcctctaccttttggaagagtactcagccctacagaaagtttcatccatgaactagatgagaagacaagtgcctctctgaagttcacggttttgaacccgaaaggtcgcatctggaccatggtcgctggtggtggtgctagtgtcatttatgctgatacagttggagacttgggatatgcatcagagcttggaaactatgcagagtatagtggtgctcctaatgaggaggaggttctgaattattctagagttgttcttgattgtgcaactgctgatcctgatggccgcaagagagcccttctcattggaggtggcatagctaacttcactgatgttgctaccacattcaatggcatcatccgagccttaagggagaaggaatccaagttgaaggcttcaagaatgcacatttatgtccgccgaggtggtccaaattaccaatctggactggctaaaatgcgtaagcttggtgcagaactcggcgttccaattgaggtgtatgggccagaagcgactatgactggaatctgcaaacaagcaattgaatgcatcatggctgcagcgtaatcagagcgtagctctgggtagtttgggatctgcaaacacgcaattgaatgtgtcatggactcagcataaatgagagatggatagtagttgcattatatagttcacacatggtgtttctgttttttgtttcagatatgttgtagcgtgttgtttgaacgaaaccttcacagatcattactgcaaagaaattgctgtgtgttaaaataaattcaaagtctagttttgtgccaaaaaaaaaaaaaaaaaaaa

SEQ ID NO: 200 - protein, 423 aa, Zea mays
MARKKIREYDSKRLLREHLKRLAGIDLTILSAQITQSTDFAELVSQQPWLSTMKLVVKPDMLFGKRGKSGLVALNLDFNQVKEFVKERLGVEVEMGGCKAPITTFIVEPFVPHDQEYYLSIVSERLGSTISFSECGGIEIEENWDKVKTIFLPTEKPMTSDSCAPLIATLPLEARGKIGDFIKGVFAVFLDLDFSFLEMNPFTMVNGEPYPLDMRGELDDTAAFKNFKKWGGIEFPLPFGRVLSPTESFIHELDEKTSASLKFTVLNPKGRIWTMVAGGGASVIYADTVGDLGYASELGNYAEYSGAPNEEEVLNYSRVVLDCATADPDGRKRALLIGGGIANFTDVATTFNGIIRALREKESKLKASRMHIYVRRGGPNYQSGLAKMRKLGAELGVPIEVYGPEATMTGICKQAIECIMAAA

SEQ ID NO: 201 - DNA, 1827 bp, Zea mays
atggcgactgggcaacttttctcaaaaactacccaagcattattctacaactacaagcaacttcccatccaacggatgcttgattttgacttcctctgcgggagagaaacaccttccgttgctggaataatcaatcctggttctgacggttttcagaaacttttctttggacaagaggaaattgctattccagttcatcctacagttgaagctgcctgcaatgcacacccaacagctgatgtatttatcaactttgcatccttccggagtgctgctgcttcctcaatgtcagctttgaagcagccaacaataagggttgtagccattatcgctgagggtgttcctgaatcagatgcaaagcagctaattagttatgcacgcgctaataataaggtcatcattggacctgcaacagttggaggaattcaagctggtgctttcaagattggtgatactgctggaaccattgacaacataattcagtgcaagctttacaggcctggatctgttggttttgtgtctaaatcgggtggcatgtcaaatgagatgtacagcaccattgccagagtgacagatggtatttatgaaggaattgcaattggaggggatgttttccctggatcaactctgtcagaccacattctgcgttttaataacataccacaggttaaaatgatggttgttcttggggagcttggtggaaaagacgagtattcacttgtggaagcattgaaacaaggaaaggtccagaaaccagttgttgcatgggttagtgggacatgtgcacgtctattcaaatcagaagtgcagtttggccatgctggtgccaagagtggtggtgagttagaatcagcacaagctaagaatcaggcactaaaggaagctggtgcaattgtgcctacttcatatgaagctcttgaaagtgcaattaaggaaacatttgacaaactgtttgaggaaggaaaaatttctcctgttactgaaattacaccgcctctcattcctgaggaccttaaaactgcaatcaagagtgggaaggtccgagctcctacccacatcatctccactatttctgatgacagaggcgatgaaccatgctatgctggtgtccctatgtctacaattattgaacagggttatggagttggtgatgttatttctcttttgtggttcaagcgcagccttcctcgcttttgcactcagtttattgagatatgcgtcatgctttgtgctgaccatggtccctgtgtatctggtgctcataactctatagttactgctagggccggaaaggaccttgtttccagcttggtgtctggattattgacgattggtccccgtttcggtggagcaattgatgatgcagcccgatacttcaaagatgcatgtgataggagcctcacgccatacgagtttgttgaaggcatgaaaaagaagggaatccgtgtgcctgggattggtcacaggattaagagcagagacaacagggataagcgtgtgcagcttctacagaaatatgctcacacacatttcccttcagtcaagtacatggaatacgctgttcaggttgagacctacaccttgtcaaaagccaacaatttggttatgaatgtcgatggtgcgatcgggtcccttttyttggatcttctatctggaagtggaatgttcaccaaacaggagatcgatgagattgtggagatcggttatctcaatgggctctttgtgcttgcacgatcaattggcctgatcgggcataccttcgaccagaaraggctcaagcagccactctaccgtcacccatgggaggatgtactttacaccaagtga

SEQ ID NO: 202 - protein, 608 aa, Zea mays
MATGQLFSKTTQALFYNYKQLPIQRMLDFDFLCGRETPSVAGIINPGSDGFQKLFFGQEEIAIPVHPTVEAACNAHPTADVFINFASFRSAAASSMSALKQPTIRVVAIIAEGVPESDAKQLISYARANNKVIIGPATVGGIQAGAFKIGDTAGTIDNIIQCKLYRPGSVGFVSKSGGMSNEMYSTIARVTDGIYEGIAIGGDVFPGSTLSDHILRFNNIPQVKMMVVLGELGGKDEYSLVEALKQGKVQKPVVAWVSGTCARLFKSEVQFGHAGAKSGGELESAQAKNQALKEAGAIVPTSYEALESAIKETFDKLFEEGKISPVTEITPPLIPEDLKTAIKSGKVRAPTHIISTISDDRGDEPCYAGVPMSTIIEQGYGVGDVISLLWFKRSLPRFCTQFIEICVMLCADHGPCVSGAHNSIVTARAGKDLVSSLVSGLLTIGPRFGGAIDDAARYFKDACDRSLTPYEFVEGMKKKGIRVPGIGHRIKSRDNRDKRVQLLQKYAHTHFPSVKYMEYAVQVETYTLSKANNLVMNVDGAIGSLFLDLLSGSGMFTKQEIDEIVEIGYLNGLFVLARSIGLIGHTFDQKRLKQPLYRHPWEDVLYTK

SEQ ID NO: 203 - DNA, 2212 bp, Zea mays
ccacgcgtccgtgcggcgaaatcccgctcccgcgttccccatcctccggccgcctcgcttcggcctccctccggaaggtgtcttaaatcatggcgactggccaacttttctcaaaaactacccaagcattattctacaattacaagcaacttcccatccaacggatgcttgattttgacttcctctgtgggagagaaacaccttctgttgctggaataatcaatcctggttctgatggttttcagaaacttttctttggacaagaggaaattgctattccggttcatcccacagttgaagctgcatgcagtgcacacccaacagctgatgtatttatcaactttgcatccttccggagtgctgctgcttcttcaatgtcagctttgaagcagccaacaataagggttgtagccattatcgctgagggtgttcctgaatcagatgccaagcagctaattagttatgcacgtgctaataacaaagtcatcattggacctgcaacagttggaggaattcaagctggtgctttcaagattggtgataccgctggaaccattgataacataattcagtgcaagctttacaggcctggatctgttggttttgtgtctaaatcgggcggcatgtcaaatgagatgtacagcaccattgccagagtgacagatggtatttatgaaggaattgcaattggaggggatgttttccctggatcaactctgtcagaccacattctgcgttttaataacataccacaggttaaaatgatggttgttcttggggagcttggtggaaaagatgagtattcactagtggaagcattgaaacaaggaaaggttgagaaaccagttgttgcatgggtcagtgggacatgtgcacgtctattcaaatcagaagtgcagtttggtcatgctggtgccaagagtggtggtgagttggaatcagcacaagctaagaatcaggcactaagggaagctggtgcagttgtgcctacatcatatgaagctctagagagtgcaattaaggaggtatttgacaaactggttgaggaaggaaaaatttctcctgtgactgaaattacacctcctcccattcccgaggaccttaaaactgcaattaagagtgggaaggtccgagctcctacccacatcatttccaccatctccgatgacagaggtgttgaaccgtgctatgctggtgtgcctatgtctacaattattgaacagggttatggagttggtgatgttatctctcttttgtggttcaagcgcagccttcctcgctattgcactcagtttattgagatatgcatcatgctttgtgcggaccatggtccctgtgtatctggtgctcataactctatagttactgctagggctggaaaggaccttgtttccagcttggtgtctggattattgacaattggcccccgttttggcggagcaattgatgatgcagcccgatacttcaaagatgcatgtgataggggcctcacaccatacgagtttgttgaaggcatgaaaaagaagggaatccgtgtgcctgggattggtcacaggattaagagcagagacaacagggataagcgtgtgcagcttctacagaaatatgctcacacgcatttcccttcagtcaagtacatggaatacgctgttcaggttgagacctacaccttgtcaaaagcaaacaatttggttatgaatgtcgatggtgcgatcgggtcactttttttggatcttctgtctggaagcggaatgttcaccaaacaggagatcgacgagattgtggaaattggttatcttaatggtctctttgtccttgcacgttcaattggcctgatcgggcacaccttcgaccagaagaggcttaagcagccactctaccgccacccatgggaggatgtcctgtacaccaagtgagatagagccattctttgcaaagcataaagtattattgtcgcttagggctttcagctgtctgtacacttcataaatcgagcagttgcaaaaaaagctcgaaattgtgattgttgatgaagttaggggcagggggagagacatcgaggggaggcactactagattgtgtgttttgtgttgagttgtttcacgatatacggcctcagaatagaagttccctttgaaatgaagtaacgctcgctgatttatgagttgataaaaaaaaaaaaaaaaaaaaaaaaaaaaaaaaaaaaaaaaa

SEQ ID NO: 204 - protein, 608 aa, Zea mays
MATGQLFSKTTQALFYNYKQLPIQRMLDFDFLCGRETPSVAGIINPGSDGFQKLFFGQEEIAIPVHPTVEAACSAHPTADVFINFASFRSAAASSMSALKQPTIRVVAIIAEGVPESDAKQLISYARANNKVIIGPATVGGIQAGAFKIGDTAGTIDNIIQCKLYRPGSVGFVSKSGGMSNEMYSTIARVTDGIYEGIAIGGDVFPGSTLSDHILRFNNIPQVKMMVVLGELGGKDEYSLVEALKQGKVEKPVVAWVSGTCARLFKSEVQFGHAGAKSGGELESAQAKNQALREAGAVVPTSYEALESAIKEVFDKLVEEGKISPVTEITPPPIPEDLKTAIKSGKVRAPTHIISTISDDRGVEPCYAGVPMSTIIEQGYGVGDVISLLWFKRSLPRYCTQFIEICIMLCADHGPCVSGAHNSIVTARAGKDLVSSLVSGLLTIGPRFGGAIDDAARYFKDACDRGLTPYEFVEGMKKKGIRVPGIGHRIKSRDNRDKRVQLLQKYAHTHFPSVKYMEYAVQVETYTLSKANNLVMNVDGAIGSLFLDLLSGSGMFTKQEIDEIVEIGYLNGLFVLARSIGLIGHTFDQKRLKQPLYRHPWEDVLYTK

SEQ ID NO: 205 - DNA, 1661 bp, Zea mays
ccacgcgtccgcgaatcccgagcacaggccgccgctcgctcgctcgctgcagctacgcacgcacgcgcctgctcctccccttagcttccacaaggctcgactcggccggcggcgatggcgcggaagaagatccgggagtacgactccaagcgcctcctccgggagcacctcaagcgcctcgccggcatcgacctccagatcctctccgcgcaggtcacacagtcaacggatttcactgagcttgcaaaccaggagccgtggctctcatctatgaagttggttgtgaaacctgacatgctctttgggaaacgtgggaagagtgggcttgtggccctcaacctagatcttgcccaagttcgccaatttgtcaaggagcggttgggagttgaggtcgagatgggtggctgcaaagctccaattacaaccttcatagttgaaccatttgtgccacatgaccaagagtactacctttcgattgtatctgaaaggcttggcaacaccattagtttctcagaatgtggaggtattgagatcgaggagaactgggacaaggttaagactatctttcttcccacagagaagcaaatgacacctgacgcatgtgctccattgattgccaccctgccattggaggtccgcacaaagataggtggtttcattagagctgtattttctgttttccaagacttggatttctcatttcttgagatgaacccattcaccttggtaaatggtgaaccgtatcctctggatatgagaggagaactagatgacacagctgctttcaaaaacttcaataagtggggcaatattgtgtttcccctaccatttggaagagttctcagtccctccgaaagttttatccatgaactggatgagaagacaagtgcttctctgaaattcacggtactgaacccaaaaggacgcatctggacaatggttgcaggtggtggtgctagtgtcatatacgcagacactgttggtgatttgggatatgcttcggagctaggaaattatgcagagtacagtggagctcccaaggaggaggaggttctgcagtatgctagagtgcttttggattgcgctacctctgatcctgatggccgtaagagagcccttctaatcggaggaggaatcgctaacttcacagatgttgcttctacatttagtggcatcattcgggctttaagagagaaggagtccaaattaaaggctgcaaggatgaacatttatgtccggagaggtggtccgaactaccaaactggactcgccaaaatgcgcaccctaggcgccgaacttggcgttccaattgaggtctatggaccagaggcgaccatgactgggatctgcaaagaagccattgattgcatcatggccgcgtaaatcacaaatgtggttgttccatttgaagtcacatccgttttgtactagacgttccttgtacgtgattgctctggtaaaacagagaacgatcattgtcatgagtaaactcggcctttgtaacacagttacgcaagtaataattaagatcttggtttggtgctctgccacccttctagggtgggccggtgaggtgaatgtacaaataacaatgcactttgtgatccaccagattgcagtgctctggtatttctaaaaaaaaaaaaaaaaaaaaaaaaaaa

SEQ ID NO: 206 - protein, 422 aa, Zea mays
MARKKIREYDSKRLLREHLKRLAGIDLQILSAQVTQSTDFTELANQEPWLSSMKLVVKPDMLFGKRGKSGLVALNLDLAQVRQFVKERLGVEVEMGGCKAPITTFIVEPFVPHDQEYYLSIVSERLGNTISFSECGGIEIEENWDKVKTIFLPTEKQMTPDACAPLIATLPLEVRTKIGGFIRAVFSVFQDLDFSFLEMNPFTLVNGEPYPLDMRGELDDTAAFKNFNKWGNIVFPLPFGRVLSPSESFIHELDEKTSASLKFTVLNPKGRIWTMVAGGGASVIYADTVGDLGYASELGNYAEYSGAPKEEEVLQYARVLLDCATSDPDGRKRALLIGGGIANFTDVASTFSGIIRALREKESKLKAARMNIYVRRGGPNYQTGLAKMRTLGAELGVPIEVYGPEATMTGICKEAIDCIMAA

SEQ ID NO: 207 - DNA, 1619 bp, Oryza sativa
gcacgagcttacagagagagagagagagaggcagagagccatggcgcggaagaagatccgggagtacgactccaagcgcctcctaagggagcacctcaagcgcctcgccgccatcgacctccacatcctctccgcccaggtcacggaatcaactgatttcacagagctcgtcaaccaagagccatggctctcgtctatgaagttggttgtgaaacccgacatgctgtttggcaaacgtgggaagagtggccttgtggccctcaacctagatcttgctcaagtccgccaattcgtcaaagagcggttgggagttgaggttgagatgggtggctgcaaggctcctattacaacattcatagttgagccatttgttccacatgatcaagagtactatctttctattgtatcagagaggcttggttccaccattagcttctcggagtgtggaggtattgagatcgaggagaactgggataaggtcaagacagtttttcttcccaccgagaaagcaatgacacctgatgcgtgtgctccattgattgccaccctaccgttagaggttcggacaaaaataggtgatttcatcagaggtgtatattctgttttccaagacttggatttctcattccttgagatgaatccgttcaccatggtgaatggggaaccatatcctctagacatgagaggagaattggacgacacagctgcctttaagaactttaagaagtatgattcaggctttttttctagcttacatagtgtccagttcaatcctttcaccatgcttgtcatgctaaccagagcttccatggcataggtggggaaacattcagttccctctgcctttcggaagagtcctcagcccctctgaaagctttatccatgaactggatgagaagacaagctcatcgctcaaattcacagtcctgaacccgaaagggcgcatttggacaatggttgcaggtggtggtgctagtgtcatatatgctgatactgttggagatttgggatatgcgtcagagcttggaaattatgcagaatacagcggcgctcccaacgaggaggaggttctgcagtatgctagagtggttttggattgtgccactgctgatcctgatggccgtaagagagctcttctcattggaggtggtatagcgaacttcactgatgtcgctgctacattcagtggcatcattcgagctttaagagagaaggaatccaaattgaaggctgcacggatgaacatttacgttcggagaggtggtccaaactaccaaactggccttgccaaaatgcgtacactaggtgcagaacttggtgttccaattgaggtatatggaccagaggcaacaatgactggaatctgcaagcaagccattgattgcatcatggctgaagcataattcagacaactatttgcgctgttcccagcttgagtccattttgtttcagaaattgtcagtgtgaggtgttgcctttctctctgagggaatgtgtgctgttgttggtgtaaaacaaaacaaagaaagatcgtattgttagaataaactacatctgtaagtttgtaacgtaattacgcaataatgttaatgtttgtttctaaaaaaaaaaaaaaaaaa

SEQ ID NO: 208 - protein, 423 aa, Oryza sativa
MARKKIREYDSKRLLREHLKRLAAIDLHILSAQVTESTDFTELVNQEPWLSSMKLVVKPDMLFGKRGKSGLVALNLDLAQVRQFVKERLGVEVEMGGCKAPITTFIVEPFVPHDQEYYLSIVSERLGSTISFSECGGIEIEENWDKVKTVFLPTEKAMTPDACAPLIATLPLEVRTKIGDFIRGVYSVFQDLDFSFLEMNPFTMVNGEPYPLDMRGELDDTAAFKNFKKWGNIQFPLPFGRVLSPSESFIHELDEKTSSSLKFTVLNPKGRIWTMVAGGGASVIYADTVGDLGYASELGNYAEYSGAPNEEEVLQYARVVLDCATADPDGRKRALLIGGGIANFTDVAATFSGIIRALREKESKLKAARMNIYVRRGGPNYQTGLAKMRTLGAELGVPIEVYGPEATMTGICKQAIDCIMAEA

SEQ ID NO: 209 - DNA, 367 bp, Oryza sativa
  unsure (266): n = A, C, G, or T
  unsure (306): n = A, C, G, or T
  unsure (308): n = A, C, G, or T
  unsure (310): n = A, C, G, or T
  unsure (318)..(319): n = A, C, G, or T
  unsure (322): n = A, C, G, or T
  unsure (328): n = A, C, G, or T
  unsure (332): n = A, C, G, or T
  unsure (347): n = A, C, G, or T
  unsure (349): n = A, C, G, or T
  unsure (357)..(358): n = A, C, G, or T
  unsure (364): n = A, C, G, or T
atcactccgatccgcccgcacccgcacacacatcgctcggtcgaaggaggaggttctagaaacttctggaagcggcggaggtgtggggagagagagagagagagagagagagagagaggcagagagccatggcgcggaagaagatccgggagtacgactccaagcgcctcctaagggagcacctcaagcgcctcgccgccatcgacctccacatcctctccgcccaggtcacggaatcaactgatttcacagagctcgtcaaccangagccatggctctcgtctatgaagttgggtgtgaaaccgnantncgtttggnnaangttggnaagntggcttggggccccnanccaaattnnggcaantcc

SEQ ID NO: 210 - protein, 79 aa, Oryza sativa
  UNSURE (46): Xaa = any amino acid
  UNSURE (60)..(61): Xaa = any amino acid
  UNSURE (64)..(65): Xaa = any amino acid
  UNSURE (67)..(68): Xaa = any amino acid
  UNSURE (74): Xaa = any amino acid
  UNSURE (77): Xaa = any amino acid
  UNSURE (79): Xaa = any amino acid
MARKKIREYDSKRLLREHLKRLAAIDLHILSAQVTESTDFTELVNXEPWLSSMKLGVKPXXVWXXLXXWLGAPXQIXAX

SEQ ID NO: 211 - DNA, 1543 bp, Oryza sativa
caagaacccacgcgcctctcgcggcagcagctaaccaagccatggcgcgcaagaagatccgggagtacgactccaagcgcctcctcaaggagcacctcaagcgcctcgccggtatcgacctccagatcctctccgcccaggttacacaatcgacggacttcacagagctggtaaaccagcagccatggctgtcaaccatgaagttggtcgtgaagcccgacatgctgttcgggaagcgtggcaagagcggacttgtggccctcaacctagatattgctcaagtcaaggagtttgtgaaggagaggctgggagttgaggtcgagatgggtggctgcaaggctccaatcaccaccttcattgtggagccatttgtaccccatgatcaagaatactacctttctattgtctcggagaggctgggcagcactattagcttctcggaatgtggaggaatagaaattgaggagaactgggacaaggttaagacaatttttcttcccactgagaagccaatgacacctgatgcatgtgctcccttgattgctacccttccattggaggcacgtggaaaaattggtgatttcattaaaggagtctttgctgttttccaagacttagatttctcatttctcgagatgaacccatttaccatcgtgaatggagagccgtatcctctggacatgagaggagaattagatgacacagcagctttcaaaaacttcaagaagtggggaaatatcgaattcccactaccattcggtagagttctcagttctacagaaggctttatccatgacttggatgagaagacaagtgcatctctgaagttcaccgttttgaacccaaaggggcgcatctggacaatggttgctggaggtggtgccagtgtcatatatgctgatacagtcggagatttgggatatgcttcagaattaggaaactatgcagagtatagcggtgctcccaatgaggaggaggttctgcagtatgctagagtagtacttgattgtgcgactgctgatcctgatggccgcaagagagctcttctcattggagggggtatagctaacttcaccgacgtcggggccacatttagcggcatcattcgggccttaagagagaaggaatccaagttgaaggctgcaaggatgcacatctatgtccgacgtggtggtccaaattaccaaactgggctggctaaaatgcgcaagcttggcgcagaactcggcgtcccgattgaggtgtatgggccagaagcgacgatgactggaatctgcaagcaagcaattgaatgcgttatggccgcagcataaatgaagatgcaagttctgggatctgcaggcaagatgctgaatgcgtgatgggtgcgacatggatgagagtgtggtgtagttgcagtagttctctgcagatggctgatttgtttcttgatacatgttatacttggacgagatctggataggttattgatgtactgaaactactactgcgatgcaataaaagtgagagtagcgtttcctgattaaaaaaaaaaaaaaaaaaa

SEQ ID NO: 212 - protein, 423 aa, Oryza sativa
MARKKIREYDSKRLLKEHLKRLAGIDLQILSAQVTQSTDFTELVNQQPWLSTMKLVVKPDMLFGKRGKSGLVALNLDIAQVKEFVKERLGVEVEMGGCKAPITTFIVEPFVPHDQEYYLSIVSERLGSTISFSECGGIEIEENWDKVKTIFLPTEKPMTPDACAPLIATLPLEARGKIGDFIKGVFAVFQDLDFSFLEMNPFTIVNGEPYPLDMRGELDDTAAFKNFKKWGNIEFPLPFGRVLSSTEGFIHDLDEKTSASLKFTVLNPKGRIWTMVAGGGASVIYADTVGDLGYASELGNYAEYSGAPNEEEVLQYARVVLDCATADPDGRKRALLIGGGIANFTDVGATFSGIIRALREKESKLKAARMHIYVRRGGPNYQTGLAKMRKLGAELGVPIEVYGPEATMTGICKQAIECVMAAA

SEQ ID NO: 213 - DNA, 2260 bp, Oryza sativa
gcacgaggttctaacctcccgtctccgctactccaaacttaattttgatttctcgccggagaattcctcctccgcctcccggctcctcccctccgccctcgcttccgcaggcgaactaaaccatggcgacaggtcaaattttctccaaaaccacccaagcgttattctataattataagcaacttccgatccaacggatgcttgattttgacttcctatgtgggagagaaacaccttctgttgctggaataatcaatcctggttctgatgggtttcagaaacttttctttggacaagaagaaattgccattccagttcatcctacaattgaagctgcctgcaatgcacacccaactgctgatgtatttatcaactttgcatcctttcggagtgctgccgcttcttcaatgtcagctttgaagcagccaacaatcagagttgtagccatcatagcagagggtgttcctgaatcagatacaaaacaacttattagttatgcacgtgccaacaacaaggtaatcattggaccagcaacagttggaggaatccaagctggtgctttcaagattggtgatactgctggaaccattgacaacattattcaatgcaagctttacaggcctggatctgttggctttgtttctaaatcgggtggcatgtcaaatgagatgtacaacaccattgccagagtgacagatggtatttatgaaggaattgcaattggaggggatgttttccctggctcaactctgtcagaccacatcctgcgtttcaacaacatacctcaggtcaaaatgatggttgttcttggggagcttggaggaaaagatgagtattctcttgttgaagccctgaaacaaggaaaggttcagaaacctgttgttgcatgggttagtgggacatgcgctcgtctattcaagtctgaagtgcagtttggccatgctggtgcgaaaagtggtggtgagttggaatcagcacaagctaagaaccaggcactaaaagatgccggggcagttgtccctacttcatatgaagctcttgaaactgcgatcaaggagacatttgagaaactggttgaggacggaaagatctctcctgttactgagattacaccacctcctattccagaggatcttaaaaccgcaattaagagtgggaaggtccgagctcccacacacattatctccactatctcggatgacagaggcgaggaaccctgctatgctggtgtccccatgtctacaattattgaacagggttatggagttggtgacgttatttcgcttttgtggttcaagcgcagtcttcctcgttactgcactcagtttattgagatgtgcatcatgctttgcgctgatcatggtccttgtgtatccggtgctcacaattctatagttactgctagggctggaaaggaccttgtttccagcttggtatctggtttattgacaattggcccccgttttggtggtgcaattgatgatgctgcccggtacttcaaagatgcatatgatagaaatctcacaccttatgagttcgttgagggtatgaaaaagaagggaatccgtgtccctgggattggtcacaggatcaagagcagagacaacagagataagagagtgcagcttctacagaaatatgcccacacacatttcccttctgtcaaatacatggagtatgctgtccaggttgagacctacaccctgtcaaaagccaacaatttggttctgaacgtcgatggtgcgattgggtcgcttttcttggatcttctttctggcagtggaatgttcagcaaacaagaaatcgatgagattgttgagattggttaccttaatggactctttgtgcttgcgcgttcaattggtctcatcgggcacacctttgaccagaagaggctcaagcaaccactctaccgccacccatgggaggatgtcctctacaccaagtgaagactcggttgttcttaatattacctagatattccagctttgtacacacttcaaaaggtcaagcgaaattgcataaaagtgaacgccgatgaaactagggggagaagaatggggtcaccggtgaccgctgttgttgcgtgtttcaagttagttgcaaattgagatctgttcctgatttttgtcaaagcaagaaccattaggacaacatgggggatattggaaatttactgtatcatcgtgtactatcgattctctcaacgaaaaaaaaatctagtctgatgctaaaaaaaaaaaaaaaaaaaaaaaaaaaa

SEQ ID NO: 214 - protein, 608 aa, Oryza sativa
MATGQIFSKTTQALFYNYKQLPIQRMLDFDFLCGRETPSVAGIINPGSDGFQKLFFGQEEIAIPVHPTIEAACNAHPTADVFINFASFRSAAASSMSALKQPTIRVVAIIAEGVPESDTKQLISYARANNKVIIGPATVGGIQAGAFKIGDTAGTIDNIIQCKLYRPGSVGFVSKSGGMSNEMYNTIARVTDGIYEGIAIGGDVFPGSTLSDHILRFNNIPQVKMMVVLGELGGKDEYSLVEALKQGKVQKPVVAWVSGTCARLFKSEVQFGHAGAKSGGELESAQAKNQALKDAGAVVPTSYEALETAIKETFEKLVEDGKISPVTEITPPPIPEDLKTAIKSGKVRAPTHIISTISDDRGEEPCYAGVPMSTIIEQGYGVGDVISLLWFKRSLPRYCTQFIEMCIMLCADHGPCVSGAHNSIVTARAGKDLVSSLVSGLLTIGPRFGGAIDDAARYFKDAYDRNLTPYEFVEGMKKKGIRVPGIGHRIKSRDNRDKRVQLLQKYAHTHFPSVKYMEYAVQVETYTLSKANNLVLNVDGAIGSLFLDLLSGSGMFSKQEIDEIVEIGYLNGLFVLARSIGLIGHTFDQKRLKQPLYRHPWEDVLYTK

SEQ ID NO: 215 - DNA, 2060 bp, Glycine max
tttgtgtgttatattaatgtgtttttaatattaatggaagaccctattttttattcgcaggtagagaaacaccgtcagttgctggaataattaatcctggttctgagggatttcaaaagctcttttttggtcaggtggaaattgccattccagttcatgctggtattgaagcagcttgtgcagcacaccccactgctgatgtgttcatcaattttgcgtcatttagaagtgcgtctgcatcatccatggctgctttgaagcagacaacaattagagttgttgctattattgctgaaggtgtaccggagtcagacactaagcaacttatagcgtatgctcgagcaaacagtaaggttgttattgggccagccactgttggaggaattcaagctggtgcttttaagataggtgacacagctgggacaattgataacataattcattgcaagctctacaggcctggatctgttggatttgtttctaaatctggtgggatgtccaatgaattatacaacactattgcccgtgtaactgatggaatttatgaaggcattgccattggtggagatgttttcccaggttccacactttctgaccatgttttgcggtttaacaacataccacaggtgaaaatgatggtagtacttggggaacttggtgggcgtgatgagtattctctagtggaagccctaaaacaagggaaagtgactaaaccagttgttgcctgggttagcggaacctgtgcacgactcttcaaatctgaagtacaatttggtcatgctggagctaaaagtggtggtgagatggagtctgctcaagcaaagaatcaggcactaaaagaagctggagctgttgttcccacttcatttgaagcttttgaagacgcaataaaggaaacatttgacaaattggttcaagaagggaacatcacaccttttaaagagtttactgcaccgccaatccctgaggaccttaacacagcaattaggagtggaaaagtacgtgctccaactcacattatttccaccatctctgatgacagaggtgaggagccatgctatgctggtgtaccaatgtctaccattattgaaaatggttatggtgtgggtgatgtaatctctcttttgtggttcaaacgcagccttccccgttactgtactcaatttattgagatatgtatcatgctatgtgctgaccatggtccttgtgtctctggtgctcacaattctatagtaacagcaagggctgggaaggaccttgtctcctgtcttgtttcaggtttgcttacaattggtcctcgatttgggggtgccattgatgatgctgctcgctatttcaaggatgcctatgacaggagtcttacaccttatgaatttgttgaaagtatgaagaagaagggcatccgtgttccaggaatagggcacagaatcaagaatagggataacaaagataagagagtcgagctgctacagaagtttgcacgcacgcattttccttctgtgaaatacatggagtatgctgttgaagttgaaaactacaccctcaccaaggcaaataacctagttctaaacgtagatggtgcaatcgggtcacttttcttggatcttcttgctggtagcggaatgttcaccaaacaagaggttgatgaaattgtggagattggctatctgaatgggctttttgttttggcacgctccattggtctgattgggcatacctttgaccagaagaggttgaaacaaccactctaccgccacccatgggaggatgttctttacacaaagtgagggggttctgtatggcaggaggagccttgttatgcttcaaattagcatcttttgggaaattatgcatcatgctggaatgatttagtttttagctgttcgacgagtatacgggtctactggtatctagccatcttcagtttgtaagttgtattaaaaattcattcatgagataacttggtcaaattgaaaattattccttctcttgaaaaaaaaaaaaaaaaaaaaaaaaaaaaaaaaaaaaaaaaaaaaaaaaaaaaaaaaaaaaaaaaaaaa

SEQ ID NO: 216 - protein, 589 aa, Glycine max
CVFNINGRPYFLFAGRETPSVAGIINPGSEGFQKLFFGQVEIAIPVHAGIEAACAAHPTADVFINFASFRSASASSMAALKQTTIRVVAIIAEGVPESDTKQLIAYARANSKVVIGPATVGGIQAGAFKIGDTAGTIDNIIHCKLYRPGSVGFVSKSGGMSNELYNTIARVTDGIYEGIAIGGDVFPGSTLSDHVLRFNNIPQVKMMVVLGELGGRDEYSLVEALKQGKVTKPVVAWVSGTCARLFKSEVQFGHAGAKSGGEMESAQAKNQALKEAGAVVPTSFEAFEDAIKETFDKLVQEGNITPFKEFTAPPIPEDLNTAIRSGKVRAPTHIISTISDDRGEEPCYAGVPMSTIIENGYGVGDVISLLWFKRSLPRYCTQFIEICIMLCADHGPCVSGAHNSIVTARAGKDLVSCLVSGLLTIGPRFGGAIDDAARYFKDAYDRSLTPYEFVESMKKKGIRVPGIGHRIKNRDNKDKRVELLQKFARTHFPSVKYMEYAVEVENYTLTKANNLVLNVDGAIGSLFLDLLAGSGMFTKQEVDEIVEIGYLNGLFVLARSIGLIGHTFDQKRLKQPLYRHPWEDVLYTK

SEQ ID NO: 217 - DNA, 1733 bp, Glycine max
  unsure (389)..(390): n = A, C, G, or T
gcacgagttcacacccaccattggatccaccaatctccaaccttcttctccactgttccgtttctctctccaacggagagtcttttgttttttgtggcgagtttgttgcacgtttaagaagcaatggcacgcaagaagatcagagagtatgactccaagaggttgttgaaggagcactttaagagaatctctggccaggagttgcccatcaagtctgcacaggttacagaatccaccaatttcagtgagctagcagagaaggaaccctggcttttatcttcaaaattggttgtgaaaccagacatgttatttggaaagcgtggcaaaagtggtttggttgccttgaatctagatttggcagaagttgattcttttgtgaaagggcgtcnnttggcaaagaggttgagatgggtgggcaaaggacctataacaactttcattgttgaaccttttatccctcacaatgaggagttttaccttaacattgtctcagagagactagggaacagtataagcttttctgaatgtggagggattgaaattgaggagaattgggataaggtcaagactgtatttatgccaacaggagtgtctcttacatcagagagtattgccccacttgttgcaacacttcccttagagatcaagggagaaattgaggaatttctcaaggtgattttcactctatttcaagacctggattttactttcttggagatgaatcctttcactttggtcaatggaaagccttatcctctggacatgaggggcgaacttgatgacactgctgctttcaagaacttcaagaaatggggaaacattgaatttccattgccatttggaagggttatgagtactacagaggctttcattcatggattagatgaaaagacaagtgcatctttgaaattcacagtattaaacccaatgggccgaatttggacaatggttgctgggggaggtgctagtgttatctatgctgatacggtaggagatcttggttatgctcctgagcttggaaactatgcagaatatagtggtgcacccaaggaagatgaggtcttgcagtatgccagagtagtgattgattgtgcaacttcaaatcctgatggccaaaagcgagcccttgtggtaggtggaggaatagctaactttactgatgttgctgctacattcagcggcataatccgtgctctgaaggagaaggaacaaaagctaaaagaagcaaagatgcacatctatgtgaggagaggaggtcccaactaccagaagggtctagcaaaaatgagggcactcggagaggaaattggcattcctattgaggtttatggacctgaggcaacaatgactggtatatgcaaacaggcaatccaatacatcactgctgctgcttaattatccattcttaggccaatgccttctattacaagtattttcatggctagtttgaagtgattgttgattcttggttccctttccaactctcagaattggtaactttggtgagttagagcataggctgttacaaatagtcatttagtcatcaaataaagtggtcaagagtgttttgtatcgtctagaattctgatattacagtcttggcacaataaactggaatgtgtaattgttttatgctatgccaagctggaattttatggctctcggctttactttcagcaagtaaattgattttctttccaaaaaaaaaaaaaaaaaaaaaaaaaaaaaaaaaa

SEQ ID NO: 218 - protein, 423 aa, Glycine max
  UNSURE (89): Xaa = any amino acid
MARKKIREYDSKRLLKEHFKRISGQELPIKSAQVTESTNFSELAEKEPWLLSSKLVVKPDMLFGKRGKSGLVALNLDLAEVDSFVKGRXLAKRLRWVGKGPITTFIVEPFIPHNEEFYLNIVSERLGNSISFSECGGIEIEENWDKVKTVFMPTGVSLTSESIAPLVATLPLEIKGEIEEFLKVIFTLFQDLDFTFLEMNPFTLVNGKPYPLDMRGELDDTAAFKNFKKWGNIEFPLPFGRVMSTTEAFIHGLDEKTSASLKFTVLNPMGRIWTMVAGGGASVIYADTVGDLGYAPELGNYAEYSGAPKEDEVLQYARVVIDCATSNPDGQKRALVVGGGIANFTDVAATFSGIIRALKEKEQKLKEAKMHIYVRRGGPNYQKGLAKMRALGEEIGIPIEVYGPEATMTGICKQAIQYITAAA

SEQ ID NO: 219 - DNA, 2077 bp, Glycine max
ccacgcgtccggtaagatctattctgtttcttcgtcatggcaaccggacaactattctcgcgtactacacaggctttgttttacaactacaagcaacttcccatccagcggatgcttgattttgacttcctttgcggcagggaaacaccatcagttgctggaataattaaccctggttctgagggatttcaaaaacttttttttggtcaggaggaaattgccatcccagtgcatgctaccgttgaagcagcttgtgctgcacatcctactgccgatgtcttcatcaactttgcttcatttagaagtgctgcagcatcatccatggctgctttaaaacagccaacaattagagttgttgctattattgctgaaggagtacccgagtcagacactaagcaattgattgcatatgcccgatcaaacaataaggttgttattggcccagccacagttggaggcattcaagcaggtgcttttaaaattggtgacacagctggaacaattgacaatataattcagtgcaagctctacaggcctggatctgttggatttgtttctaaatctggtgggatgtccaatgaactatacaacactattgcccgcgtaactgatgggatttatgaaggcattgctattggaggagatgttttccctggttccacactttctgaccatgttttacggtttaacaacatgccacaggttaaaatgatggtagtacttggggaacttggtgggcgtgatgagtattccttagtggaggccttaaaacaaggaaaagtatccaaaccggttgttgcctgggtcagtgggacatgtgcacgactattcaaatctgaagtacaatttggtcatgcaggagccaaaagtggtggtgagttggagtctgctcaagcaaagaatcaggcactaagggatgctggagctgttgttcccacatcatatgaagcttgaagtttcaattaaggaaacatttgataaattggttgaagatgggaagatcacaccaatcaaggaaatcacacctccaccaatccctgaggaccttagtactgcaattaagagtggaaaagtccgtgctccaactcatattatttccaccatttctgatgacagaggagaggagccatgctatgctggtgtacccatgtcttccattattgaaaaaggttatggtgttggtgatgttatctctcttttgtggtttaaacgaagccttccccgttactgtactcaatttattgagatatgcatcatgctatgtgccgaccatggtccttgtgtctctggtgctcacaatactattgtgacagcaagggctgggaaggacctagtttctagtcttgtatcaggtttgcttacaattggtcctcgatttgggggtgccattgatgatgctgctcgctacttcaaggatgctcatgacagggcgcttagtccttatgagtttgttgaaagtatgaagaagaagggaattcgtgtgccaggaatagggcacaggatcaagaatagggacaacaaagataagagagttgagctgctacagaagtttgcacgcacacattttccttctgtgaaatacatggaatatgctgttcaagttgagacctacacgctcacaaaggcaaataatttagttcttaacgtagatggtgcaattggatctcttttcttggatcttcttgctggtagtggaatgttcaccaaacaagagattgatgaaattgtggagattggctatctgaatggcctctttgtgctggcacgctccattggtctgattgggcacacctttgaccaaaagcgattgaagcaaccactttaccgtcacccatgggaggatgttctctacacaaagtgagaaagttttgtgcgactgtaagaacttcacatgcttcaaattagcaatcttttgggaaatcatgcacatctgaaatatgctggagtggttttgtagctgttagactagtgttgtacgatctattggtgaaaagtcatcttccatttgtaacttgtattaaatttcataaagagagaacttggtcatttttaaaaaaaaaaaaaaaaaaaaaaaaaa

SEQ ID NO: 220 - protein, 608 aa, Glycine max
  UNSURE (305): Xaa = any amino acid
MATGQLFSRTTQALFYNYKQLPIQRMLDFDFLCGRETPSVAGIINPGSEGFQKLFFGQEEIAIPVHATVEAACAAHPTADVFINFASFRSAAASSMAALKQPTIRVVAIIAEGVPESDTKQLIAYARSNNKVVIGPATVGGIQAGAFKIGDTAGTIDNIIQCKLYRPGSVGFVSKSGGMSNELYNTIARVTDGIYEGIAIGGDVFPGSTLSDHVLRFNNMPQVKMMVVLGELGGRDEYSLVEALKQGKVSKPVVAWVSGTCARLFKSEVQFGHAGAKSGGELESAQAKNQALRDAGAVVPTSYEXLEVSIKETFDKLVEDGKITPIKEITPPPIPEDLSTAIKSGKVRAPTHIISTISDDRGEEPCYAGVPMSSIIEKGYGVGDVISLLWFKRSLPRYCTQFIEICIMLCADHGPCVSGAHNTIVTARAGKDLVSSLVSGLLTIGPRFGGAIDDAARYFKDAHDRALSPYEFVESMKKKGIRVPGIGHRIKNRDNKDKRVELLQKFARTHFPSVKYMEYAVQVETYTLTKANNLVLNVDGAIGSLFLDLLAGSGMFTKQEIDEIVEIGYLNGLFVLARSIGLIGHTFDQKRLKQPLYRHPWEDVLYTK

SEQ ID NO: 221 - DNA, 1567 bp, Glycine max
gcacgagaatagtaagacagagcacctactcactcgtaaatggcgaggaagaagatcagagagtaccactccaagaggcttctcaaggagcatctcaaacgtctcgcctctatcgacctccaaatcctctcagctcaggtgacagaatctacggatttcactgagctgacagaccagcatccatggctttcgtcaaccagattggtcgtcaagccagacatgctgttcgggaagcgcggcaagagtggcttagttgctctcaatttagacatagctcaagtcgccgagttcgtcaaagcacgcctcggcgttgaggttgagatgggaggttgcaaggcgcctataaccacttttattgtcgaaccgtttgttcctcacgaccaagagttttatctgtctattgtttctgaaaggcttggctccactatcagcttctccgaatgtggcggcattgaaattgaagagaattgggataaggtcaaaactatattccttccgacggaaaaaccattgactccggaggcatgtgcgccattgattgctatacttcctttggagattagggggacaattggcgatttcataatgggtgtgtttgctgtcttcaaagatctggacttcagttttttagagatgaatccatttacactggtgaatgaaaagccatatccactggatatgagaggggaattggatgacactgccgcattcaagaacttcaacaagtggggtaatatagaatttccattgccttttggaagaattctgagccctacagaaagcttcattcattccttggatgataagacaagtgcatcattgaaatttactatattgaatccgaaaggacgcatatggacaatggtagcaggaggtggtgcaagtgtaatttatgctgatacggttggagatttaggctatgcatcagagcttggaaactatgctgagtatagtggagctccgaatgaggaggaggtgttgcagtatgcaagagttgtaattgattgtgctactgaagaccccgatggccgtaagagagcccttcttattggaggtggcatagcaaacttcactgatgttgctgccacattcaacgggattattcgagccctgaaagagaaggaatcaaagcttaaagcagcgcaaatgcacatatatgtcagaagaggtggtccaaactaccagactggtttggcaaagatgcgtgcattgggggaggagttgggagtaccaattcaggtttatggaccggaggccacgatgacgggtatctgcaaacaagctattgattgcatcatgtccgaagcataaagaagattaatttttgtctcatcatgtttcatttgtgaaactaatttggtggtgttttgatggatatattgatataagtccataatctgaaccaaagcaaagagtaataaggtgaagatgatagatgttacaagcctgaaactgttaaattcttatcttttcttcctattgtgattttattgttatattttgactaaacattataaaaatccccaatagtatccgtgaaaaaaaaaaaaaaaaaaaaaaaaaaaaa

SEQ ID NO: 222 - protein, 423 aa, Glycine max
MARKKIREYHSKRLLKEHLKRLASIDLQILSAQVTESTDFTELTDQHPWLSSTRLVVKPDMLFGKRGKSGLVALNLDIAQVAEFVKARLGVEVEMGGCKAPITTFIVEPFVPHDQEFYLSIVSERLGSTISFSECGGIEIEENWDKVKTIFLPTEKPLTPEACAPLIAILPLEIRGTIGDFIMGVFAVFKDLDFSFLEMNPFTLVNEKPYPLDMRGELDDTAAFKNFNKWGNIEFPLPFGRILSPTESFIHSLDDKTSASLKFTILNPKGRIWTMVAGGGASVIYADTVGDLGYASELGNYAEYSGAPNEEEVLQYARVVIDCATEDPDGRKRALLIGGGIANFTDVAATFNGIIRALKEKESKLKAAQMHIYVRRGGPNYQTGLAKMRALGEELGVPIQVYGPEATMTGICKQAIDCIMSEA

SEQ ID NO: 223 - DNA, 2000 bp, Glycine max
gcacgaggcaagagaaagactccttcggttgcaggtattatttacacattcggtggtcaattcgttagcaagatgtactggggaaccagcgaaactttgcttccagtttaccaagatgttggaaaggccatggcgaagcacgaggatgtcgataccgttgttaactttgcttcatcgcgaagtgtctaccaatccactatggaacttttggaatacccacaaattaagtcaattgccatcattgctgagggtgtacctgaaagacgtgctcgtgaaattcttcatgcagcagccaagaagggtgttacaattattggtccagctaccgtcggcggaatcaagccaggatccttcaagattggtaacactggtggtatgatggacaacattgttgcatccaagctttaccgcaagggttccgttggttacgtctccaaatctggtggtatgtccaacgagctcaacaacattatcgccaacacaaccgatggtgtttacgagggtgttgccattggtggtgacagatacccaagcacaacctttatcgaccatctcctcagatatcaagccgatccagaatgtaagattttggtcctgttaggagaagttggtggtgttgaggaatacagagttattgaggccgttaagaacggaaccatcacaaagccaattgtcgcatgggcaattggtacttgcgcaagcatgttcaagactgaggtccaattcggacacgctggttcatttgcgaactcacagctcgagactgcagctactaagaacaagtccatgaaggaagctggtttccacgtcccagataccttcgaagatatgccagcagtactcgcctccgtgtacgaaaaacttgttgcagatggaaccatcgtaccacaacctgagccaatcgtaccaaagatcccaattgattactcatgggctcaagaacttggtcttatccgaaagcctgctgctttcatctccaccatttccgatgatcgtggacaggaacttttgtatgctggcatgccaatctctgatgtcttcaaggaggatatcggaattggtggagtcatgtctcttttgtggttccgtcgtcgtcttccagattatgcaagcaagttcctcgagatggtcctcatgcttactgccgatcacggtccagctgtttctggcgccatgaacactatcattaccaccagagccggaaaggatcttatctctgctctcgtttccggtctcttgaccattggatccagattcggtggtgctcttgacggtgccgctgaggagttcaccaaggcatttgacaagggtctctccccacgtgatttcgtcgacaccatgagaaagcaaaacaagcttatcccaggtattggacacaaggtcaagtcaagaaacaacccagatcttcgtgtcgagctcgtaaaggagttcgtcaagaagcgtttcccaagctgcaagatgctcgactacgctttggctgtcgaatccgtcaccacctccaagaaagacaacttgatcttgaacgttgatggtgccgttgccgtctgtttcgttgatttgatgcgcaattgcggtgcatttagtgcagaggaggctgaagattacatgaagatgggtgtattgaacggtctcttcgttctcggacgttccattggtttgattgctcattaccttgatcaaaagagactgcgcactggtctctacagacatccttgggatgatattacctaccttttgccatctttgtcttcgggagctccgggcactgagggtcgtgttgaggtgcagatgtaaggagcgtctagttgaagatggttttgtaaacgcaaatgcgaggggtggaagttatagagcatgcttctacttgttacagggattttttttctgatccaatatgctggatggagtttttaagatcaatcatgtagtagatgaagaattgctatagagcaagattttttaatggaaatgaaatcaaaaaaaaaaaaaaaaaaaaaaaa

SEQ ID NO: 224 - protein, 597 aa, Glycine max
ARGKRKTPSVAGIIYTFGGQFVSKMYWGTSETLLPVYQDVGKAMAKHEDVDTVVNFASSRSVYQSTMELLEYPQIKSIAIIAEGVPERRAREILHAAAKKGVTIIGPATVGGIKPGSFKIGNTGGMMDNIVASKLYRKGSVGYVSKSGGMSNELNNIIANTTDGVYEGVAIGGDRYPSTTFIDHLLRYQADPECKILVLLGEVGGVEEYRVIEAVKNGTITKPIVAWAIGTCASMFKTEVQFGHAGSFANSQLETAATKNKSMKEAGFHVPDTFEDMPAVLASVYEKLVADGTIVPQPEPIVPKIPIDYSWAQELGLIRKPAAFISTISDDRGQELLYAGMPISDVFKEDIGIGGVMSLLWFRRRLPDYASKFLEMVLMLTADHGPAVSGAMNTIITTRAGKDLISALVSGLLTIGSRFGGALDGAAEEFTKAFDKGLSPRDFVDTMRKQNKLIPGIGHKVKSRNNPDLRVELVKEFVKKRFPSCKMLDYALAVESVTTSKKDNLILNVDGAVAVCFVDLMRNCGAFSAEEAEDYMKMGVLNGLFVLGRSIGLIAHYLDQKRLRTGLYRHPWDDITYLLPSLSSGAPGTEGRVEVQM

SEQ ID NO: 225 - DNA, 1561 bp, Glycine max
gcacgagctatccactcacctgcctcttcctcacccctttctccatctaacgagtaaggaaaaatggcgcgtaagaagatcagagagtatgactcaaagaggttgttgaaggagcactttaagagactttctggcaaggagttgccgatcaagtctgcacaaattactgcatcaactgatttcactgagctacaagagaaggaaccctggctttcatcttctaaattggttgtgaaacctgacatgttatttggaaagcgtggcaaaagtggtttggttgccttaaatttggattttgcacaagttgtttcgtttgtgaaggagcgtcttggaaaagaggttgagatgagtggatgcaaaggacccataacaactttcattgtcgaacctttcatcccacacaatgaagagttttaccttaacattgtctccgagagacttgggaacagcataagcttttcagaatgtggaggaattgaaattgaagacaactgggataaggttaagactgcatttgttccaacaggagtgtctcttacgtcagaaattgttgccccacttgttgcaacccttcccttggagatcaagggagaaattgaggagtttctcaaagtggttttcactctgtttcaagacctggattttactttcttagagatgaatcctttcacattggttgatggaaagccttatcctttggatatgagaggcgagctagatgacactgctgctttcaagaacttcaagaaatggggagacattgaatttccactgccatttggaagggttatgagtgccaccgagtctttcattcatggattagatgaaaagacaagtgcatccttaaaattcacagtgttgaacccaaagggccgaatttggacaatggtagctgggggaggtgctagtgtcatttatgctgatacggtaggagatcttggctttgcatctgagcttggaaactatgctgaatacagtggtgcacccaaagaagaggaggtcttgcagtacgccagagttgtaattgattgtgcaactgcaaaccctgatgaccagaagagagctcttgtgataggaggaggcatagccaactttactgatgttgctgccacatttagtggtataattcgggcattgaaggagaaggagtcaaaattgaaagcagcaaggatgcacatctttgtgaggagagggggtcccaactaccagaagggtctagctttgatgcgagcgcttggagaggatattggcatccccattgaggtttatggacctgaagccacaatgactggtatatgcaaagaggcaatacagttcattactgctgccgcttaaggtcaacaacaccttcatttatagtattttcatggcaagtctgaagtgaacgtttgattcttaatttccttgcccattcctgaaattcggaaatatagttagagaatgtttatgaaatcaatccatacaagaaagagtggccaggcttgtcatattgtttttgtagaattctgatggtgttgtcttgacacaataaagagtgtttttcaaaaaaaaaaaaaaaaaa

SEQ ID NO: 226 - protein, 423 aa, Glycine max
MARKKIREYDSKRLLKEHFKRLSGKELPIKSAQITASTDFTELQEKEPWLSSSKLVVKPDMLFGKRGKSGLVALNLDFAQVVSFVKERLGKEVEMSGCKGPITTFIVEPFIPHNEEFYLNIVSERLGNSISFSECGGIEIEDNWDKVKTAFVPTGVSLTSEIVAPLVATLPLEIKGEIEEFLKVVFTLFQDLDFTFLEMNPFTLVDGKPYPLDMRGELDDTAAFKNFKKWGDIEFPLPFGRVMSATESFIHGLDEKTSASLKFTVLNPKGRIWTMVAGGGASVIYADTVGDLGFASELGNYAEYSGAPKEEEVLQYARVVIDCATANPDDQKRALVIGGGIANFTDVAATFSGIIRALKEKESKLKAARMHIFVRRGGPNYQKGLALMRALGEDIGIPIEVYGPEATMTGICKEAIQFITAAA

SEQ ID NO: 227 - DNA, 2371 bp, Triticum aestivum
gcacgaggagcaattctgcctccgcttcgtcttgccctgcctcgcatcggaaggggaagtagatcatggcgacgggtcaaattttctcgaaaaccacccaagcattattctataattataagcaactccctatacaacggatgcttgattttgacttcctctgtgggagagaaacaccttctgttgctggaataatcaatcctggttctgatgggttccagaaacttttctttggacaagaagaaattgctattccggttcatcctacaattgaagctgcttgcaatgcacacccaactgcggatgtatttatcaactttgcatctttccggagtgcggctgcttcttcaatgtcagctttgaagcagccaactgtccgagttgtagccattatagcagagggtgttcctgaatcagacgcaaagcagctaattagctatgcacgtgctaacaacaaggtcatcattggacctgcaacagttggaggagttcaagctggtgctttcaagattggtgatactgctggaaccattgataacttaattcaatgcaagctgtacaggcctggatcagttggttttgtgtctaaatcgggtggcatgtcaaatgagctgtacaacacgattgcaagagtgactgatggtatttatgaaggaattgcaattggtggggatgttttccctggctcaactctttcagatcacattctgcgttttaacaacataccccaggttaaaatgatggttgttcttggggagcttggaggaagtgatgagtattcactcgtcgaagccttgaaacaaggaaaggttcagaaacctgttgttgcttgggttagtgggacatgtgcacgcctattcaaatctgaggtccagtttggccatgctggtgcgaagagcggtggtgagttggaatccgcacaagctaagaatcaggcactaagggatgctggggcagttgtcccgacttcatttgaagctcttgaaagtgtgattaaggagacatttgagaagctggttgaggaaggaaatattcctcctgtccctgaggttacacctccccccattcctgaggatcttaaaactgccattaaaagtgggaaggtccgagctcccacacacattatctccactatctctgatgatagaggtgaggaaccttgctatgctggtgtgcccatgtctacaattattgaaaggggttatggagttggtgatgttatttctcttttgtggttcaagcgcagccttcctcgttattgtactcaatttattgagatatgcatcatgctttgcgctgatcatggtccttgtgtatccggtgctcacaattctatagttactgctagggctggcaaggaccttgtttccagcttggtatctggattattgacaattggcccccgatttggtggtgcaattgatgatgccgctcggtacttcaaagatgcatatgataggggtcttacgccttatgaatttgttgagggcatgaaaaagaagggaatccgtgtccctgggattggtcacaggatcaaaagcagagacaacagggacaagagagtgcagcttttacagaaatatgctcacacacacttcccttcagtcaagtacatggagtacgctgttcaggttgagacctacaccctgtcaaaggccaacaatttggttatgaacgttgacggtgcgattggctcgcttttcttggatcttctttctgggagtggaatgttcagcaagcaagagatcgatgagattgtagagattgggtatcttaatggactctttgtgcttgcacgttcaattggcctaattggccacacctttgatcagaagaggctcaagcaaccactctaccgtcacccttgggaggatgtcctctacaccaagtgaggccgactcagcatggcatcatatggatcttccagttgtgtgtacaccataaaatcaagcataattgcatagaattcgaagttctgattgtcaactaggcgaggagggagagaggaccgttacagatgagcactggctgtgtgtcttgtgggactgttttttttataagctccaaagtaagtcttttttttttgttcaagcatgaaagctttagggcatcagatatttgagaggatacttgataattgtttcatgttatcatcaattaagtgaccgccaaatttggggagtgttgtaatgtttgtgatgctagttccccatcacaaaaaatccgaattctgtaatgtcaaattatgtggtacgagtaataaaatagaatatgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 228 - protein, 608 aa, Triticum aestivum
MATGQIFSKTTQALFYNYKQLPIQRMLDFDFLCGRETPSVAGIINPGSDGFQKLFFGQEEIAIPVHPTIEAACNAHPTADVFINFASFRSAAASSMSALKQPTVRVVAIIAEGVPESDAKQLISYARANNKVIIGPATVGGVQAGAFKIGDTAGTIDNLIQCKLYRPGSVGFVSKSGGMSNELYNTIARVTDGIYEGIAIGGDVFPGSTLSDHILRFNNIPQVKMMVVLGELGGSDEYSLVEALKQGKVQKPVVAWVSGTCARLFKSEVQFGHAGAKSGGELESAQAKNQALRDAGAVVPTSFEALESVIKETFEKLVEEGNIPPVPEVTPPPIPEDLKTAIKSGKVRAPTHIISTISDDRGEEPCYAGVPMSTIIERGYGVGDVISLLWFKRSLPRYCTQFIEICIMLCADHGPCVSGAHNSIVTARAGKDLVSSLVSGLLTIGPRFGGAIDDAARYFKDAYDRGLTPYEFVEGMKKKGIRVPGIGHRIKSRDNRDKRVQLLQKYAHTHFPSVKYMEYAVQVETYTLSKANNLVMNVDGAIGSLFLDLLSGSGMFSKQEIDEIVEIGYLNGLFVLARSIGLIGHTFDQKRLKQPLYRHPWEDVLYTK

SEQ ID NO: 229 - DNA, 1535 bp, Triticum aestivum
gcacgaggcaaaccaccggtaccacagcgtccacctacccgtcctccgcctcgagaagcgtcggcgaggccatggcgcggaagaagatccgggagtacgactccaagcgcctcctcaaggagcacctgaagcgcctcgcaggcatcgacctccagatcctctccgcgcaggtcacacaatcaacggatttcacggagctttcaaaccaggagccatggctctcgtcgatgaagttggttgttaaacctgacatgctgtttggcaagcgtgggaagagtggccttgtagccctcaacctagatcgtgctcaagtccgccaatttgtcaaggagcgattaggagttgaggtcgagatgggtggatgtaaggctccaattacaacattcatagtcgagccatttgtgccacacgatcaagagtattatctctcaattatgtcagacaggcttggttgcaccattagtttctcagagtgtggtggtattgagattgaggagaactgggacaaggttaagacaatctttcttccaacagagaagccaatgacacttgatgcatgcgctccattgattgccactcttcccttggaagtccgcacgaaaataggcgatttcattagagggtcattttctgttttccaagacttggatttctcatttatggagatgaacccattcaccctggtaaatggtgaaccataccctctcgacatgagaggtgaactggatgacacagctgctttcaagaactttaagaagtggggtgacattgaattccctctacctttcggaagagtcctgagcccatcagaaagttatatccatgaactggatgagaagacaagcgcatcactgaaattcacagttcttaacccgaaaggtcgcatttggacaatggttgcaggtggtggtgctagtgtcatatatgccgacacggttggagatttgggatatgcttcagagctagggaattatgcagagtacagtggagctcccaaagaggaggaagttttgcattatgctagagtggttttggattgtgccactgctgatcctgatggccggaagagagctcttctcattggagggggtatcgcaaacttcactgatgtcgctgctacattcagtggcatcattcgggctttaagagagaaggaatccaaattaaaagctgcaagggtgaacatttatgttcgcagaggtggtccaaactaccaaactggactcgccaaaatgcgtgctctaggatcagagcttggtcttccaattgaggtctatggaccagaggccacaatgactggaatctgcaagcaagccattgattgtgtcatggctgaagcatgattcgtcgttgtatagttccggtgtttaagttgtgtccatttttttccatatacatttagtatgaacaactattcgtgtgaagcaaacggagaaagatcggttttgtgggggaaagaaactacagttgtaatgcaactacgcaataatatatatcttgctttgcggttcaaaaaaaaaaaaaaaaaaaaaaaa

SEQ ID NO: 230 - protein, 423 aa, Triticum aestivum
MARKKIREYDSKRLLKEHLKRLAGIDLQILSAQVTQSTDFTELSNQEPWLSSMKLVVKPDMLFGKRGKSGLVALNLDRAQVRQFVKERLGVEVEMGGCKAPITTFIVEPFVPHDQEYYLSIMSDRLGCTISFSECGGIEIEENWDKVKTIFLPTEKPMTLDACAPLIATLPLEVRTKIGDFIRGSFSVFQDLDFSFMEMNPFTLVNGEPYPLDMRGELDDTAAFKNFKKWGDIEFPLPFGRVLSPSESYIHELDEKTSASLKFTVLNPKGRIWTMVAGGGASVIYADTVGDLGYASELGNYAEYSGAPKEEEVLHYARVVLDCATADPDGRKRALLIGGGIANFTDVAATFSGIIRALREKESKLKAARVNIYVRRGGPNYQTGLAKMRALGSELGLPIEVYGPEATMTGICKQAIDCVMAEA

SEQ ID NO: 231 - DNA, 1736 bp, Triticum aestivum
gcacgagatagtgatgtggactgtgttgttaattttgcttcttcacgaagtgtatacacatctacaatggagttaatggagtatcctcaaattaaatctattgctatcattgctgagggtgtccctgaaagacgcgcccgagaaatcctccatgtagccaagaaaaagggtattactattattggtcctgctaccgttggcggtattaagcccggctcattcaagattggaaatacaggagggatgatggacaacatcgtcgcctccaagctctaccgaaaaggatctgtcggctatgtctccaaatcaggaggaatgtcaaatgagctgaataatatcatagccaacacgactgatggtgtatacgaaggcgttgcaattggaggagatagatatcccagcactacttttatcgaccatttgttacggtaccaggctgatccagattgcaagatccttttgcttctcggtgaagttggaggagtcgaagaatatcgagttatcgaagctgtcaagagaggagaaattacaaagcctatcgtagcctgggctattggaacctgtgcgagtatgtttaccacagaagtccagtttggacacgctggctcatttgccaactctcaactcgagacagcggcagttaaaaacaaatcaatgcgggaggctggattctatgtacctgatactttcgaagacttaccaaaattgctgtcttccgtgtatcagaaaatgctcaaagacggctctatagttcctcaacctgagccagcagtaccgaaaattcctctcgattactcatgggctcaagaactcggtctcattagaaaaccagcagcatttatttccaccatatccgatgatagaggacaggaactcttgtatgctggtatgcccatatctgatgtgtttagagaagagatcggaattggaggagtaatgtcactactctggttccgtcgtcgccttccagattatgctagcaaattcctggaaatggtcctaatgttgacagctgatcacggtcctgctgtctctggtgccatgaacactattatcacaaccagagctggaaaggatttgattagcgccctcgtcagcggactattaactataggatcaaggtttggtggggccctcgatggggctgcggatgaattcacaaaagcatttgacaaagggttaagcccacgtgactttgttgataccatgcgaaagcagaacaaattaatacctggaattggtcacaaggtcaagtctcggaataatccagatcttcgtgtcgagcttgtaaaggagttcgtcaaaaagcgtttcccgtcctgcaagatgttagattatgctcttgccgtcgaaactgtcactacttcgaagaaagataacttaattttaaatgtcgacggtgcagtagctgtttgctttgttgacttaatgcggaactgcggtgcattcagtgccgaggaggcagaagactacttgcgaatgggagtattaaacggactgtttgtcctaggtcggagtataggtctgatcgcccattatcttgaccagaagagacttcgaactggtctataccgacatccttgggatgatattacgtatctattgccaagcttgggatctagcggtagcttaggtacagaaggacgtgtagaggttcaaatgtaaataagctatttaaagattctatttgatacaatcaagcagttactggtcataaaaaaaaaaaaaaaaaaaaa

SEQ ID NO: 232 - protein, 554 aa, Triticum aestivum
ARDSDVDCVVNFASSRSVYTSTMELMEYPQIKSIAIIAEGVPERRAREILHVAKKKGITIIGPATVGGIKPGSFKIGNTGGMMDNIVASKLYRKGSVGYVSKSGGMSNELNNIIANTTDGVYEGVAIGGDRYPSTTFIDHLLRYQADPDCKILLLLGEVGGVEEYRVIEAVKRGEITKPIVAWAIGTCASMFTTEVQFGHAGSFANSQLETAAVKNKSMREAGFYVPDTFEDLPKLLSSVYQKMLKDGSIVPQPEPAVPKIPLDYSWAQELGLIRKPAAFISTISDDRGQELLYAGMPISDVFREEIGIGGVMSLLWFRRRLPDYASKFLEMVLMLTADHGPAVSGAMNTIITTRAGKDLISALVSGLLTIGSRFGGALDGAADEFTKAFDKGLSPRDFVDTMRKQNKLIPGIGHKVKSRNNPDLRVELVKEFVKKRFPSCKMLDYALAVETVTTSKKDNLILNVDGAVAVCFVDLMRNCGAFSAEEAEDYLRMGVLNGLFVLGRSIGLIAHYLDQKRLRTGLYRHPWDDITYLLPSLGSSGSLGTEGRVEVQM

SEQ ID NO: 233 - DNA, 1707 bp, Zea mays
gcacgaggagcagctcccctgcccctcgcagcggctactctacaggtctagcgactctttcgccatccatagagggaggaggcgcggcggagatggtgggcggtggcggcggcgggccgctgcggcgggtgggcaagtacgaggtgggacgcaccatcggggaaggcaccttcgccaaggtcaagttcgcgcagaacaccgagaccggggagagcgtcgccatgaaggtgctcgaccgctcctccatcctcaagaacaagatggccgaacagattaagagagaaatatccataatgaagcttgtcaggcatcccaatgtcgttaggctacacgaggttttggcaagccggaagaagatatttataattctggagttcatcactggcggcgagctattcgataaaattattcgtcatgggagactcagtgaagcagatgcccgcagatactttcagcagcttattgatggtgttgatttttgtcacaagaaaggagtctaccatcgagacttaaagcctgaaaatctcctccttgattcccaaggcaatcttaaaatttcagactttggactgagtgcatggcctgctcagggatctttccttctacgtacaacctgtgggactccgaactatgttgccccagaggttctcagtcataagggatataatggcgcacttgctgatacatggtcatgtggagtaattttatatgtattgttagcaggttatcttccatttgatgaagtggacctgactaccctttatggaaagattgagagtgcagaatattcattcccagcctggttttcaggtggtgcaaaatcactgattcgtagaattcttgacccaaatccagagacacgaatcaggatagaagagatcagaagcgatgaatggtttcagaaaaattatgaacctatcaaagaaatagaaaatgaggaagtcaatctcgatgatgtcaatgcagcttttgatgatcctgaggacgataatgaggatgctttcgaagatgaaacaggtcctctaacacttaatgcattcgacctaatcattctttcgcaaggattgaatcttgcagcgctctttgaccgcagacaggactgtgacaagcttcaaaatagattcttatcacgcaatccagcaaaggttatcttgtcaagcatggaggttgttgcgcaatcaatgggatttaagacacacattcgcaattataagatgagggtggaaggtctaaatgccgacaagactagtcatctctcagttatggttgaagttttcgaagttgctccatcaatcttcatggtagaactacaaagagcagcaggagatacttcagagtataacacgttcgtaaataactactgcggcaaattagatgatatcatctggaaatttccaactgagaagggaaaatcaaggataccccggttatcaaagtctcattcataatctagtgctgtgtgttatcaattactatggacttaagtggatatatttgcagagtgtatcgcaattggattatgatattctaagtgtagctcttcgagtagtatatgtttgtatattcagagtccccatgtacaaagaggccgttttaattgaggtttccgtacctcgattccctgtgcaaagttttcatcgatgttttagactgcacatctgtatattttgtcgagagcatcagtttcttaaaaaaaaaaaaaaaaaa

SEQ ID NO: 234 - protein, 481 aa, Zea mays
TRSSSPAPRSGYSTGLATLSPSIEGGGAAEMVGGGGGGPLRRVGKYEVGRTIGEGTFAKVKFAQNTETGESVAMKVLDRSSILKNKMAEQIKREISIMKLVRHPNVVRLHEVLASRKKIFIILEFITGGELFDKIIRHGRLSEADARRYFQQLIDGVDFCHKKGVYHRDLKPENLLLDSQGNLKISDFGLSAWPAQGSFLLRTTCGTPNYVAPEVLSHKGYNGALADTWSCGVILYVLLAGYLPFDEVDLTTLYGKIESAEYSFPAWFSGGAKSLIRRILDPNPETRIRIEEIRSDEWFQKNYEPIKEIENEEVNLDDVNAAFDDPEDDNEDAFEDETGPLTLNAFDLIILSQGLNLAALFDRRQDCDKLQNRFLSRNPAKVILSSMEVVAQSMGFKTHIRNYKMRVEGLNADKTSHLSVMVEVFEVAPSIFMVELQRAAGDTSEYNTFVNNYCGKLDDIIWKFPTEKGKSRIPRLSKSHS

SEQ ID NO: 235 - DNA, 1948 bp, Zea mays
gtcgacccacgcgtccggaccaaagccgggcatacgcccccaagtccaaaagccctctccgccccgctctcccactcgtaggtgttctccccgtctccgcccgcactcgctcgtccgcgcgcaggaaggttgacctgtcgagggccggcgaacccggtaagtaagagtgaaaatggatggaagtagtaaagggagtgggcattctgaagcattaaggaactacaacctgggaagaactttaggtatcggtacatttggaaaagtgaagattgcagagcataagcttactggacatagggttgctataaagatcatcaactgccgccaaatgagaaatatggaaatggaagagaaagcaaagagagaattcaagatattgaagttgttcattcacccccatatcattcggctttatgaggtcatatacacacctacagatatatatgttgtgatggaatattgtaagtatggcgagttatttgattacattgttgagaaaggcagattacaggaagatgaagctcgtcgaatcttccagcagatcatatctggcgtcgaatactgccatagaaacatggttgtccaccgtgacctaaagccggaaaacttgttacttgattcaaagtataatgtaaaacttgcggattttggtctgagcaatgtcatgcatgatggccattttctgaagactagctgtgggagtccgaactatgctgctccagaggtaatatctggtaaactatatgctggacctgaggtcgatgtatggagttgtggggtgattctttatgctcttctttgtggaactcttccatttgatgatgagaatattcccaatctgttcaaaaaaattaagggaggtatctacacacttccaagtcatttgtctgctttggccagggatttgatcccacgaatgcttgttgttgagcctatgaagagaatcacaattagggaaattcgggagcatcaatggttccagattcgccttccacgttacttggcagtgcctccaccagatacgacacaacaagccaaaatgattgatgaagatacacttcgagatgttgttaatatgggatttaacaagaaccatgtgtgtgaatcactgtgcagcagacttcaaaatgaggcaactgttgcatattatttactattggacaatcggtttagagcaactagtggctatcttggggcagattatcaagaatcaatggacaggaatttaaatcagctggcgtcatctgaatcatctagttctggtacgaggaattatgttccaggaagcagtgatcctcatagcagtggtttgcggccatattatcctgttgaaagaaaatgggcgcttggacttcagtctcgggcccaccctcgtgaaataatggttgaggtcttaaaagcacttcaagaattaaacgtcagatggaagaagaatgggcactacaacgtgaaatgcagatggtgcccagggtttcctgaagttaatgacacgttagatgccagcaacagctttcttggtgactctaccatcatggataatgatgatgctaatgggaggctacctactgtgatcaagtttgaattccagctttacaagacgaaggacgacaagtacctcttagatatgcagagagttactggacctcagctgctcttccttgacttctgtgcggccttccttaccaagcttagggttctatagtggtctaccatgtgcaaattttcactgtggtgatgaataaccgaaagcatgtaaataggaaccttgttctcgtcttttggacaacgaacatgtttgagtgactggtcttgtgttgagcgcgtaaaggtcatgtatacttaggttagtactattttcgttcttaaatatttgtcgtctgctagtgatagttcatttttgaactaaaacgttacgaataaaaaaagagtaaaaaaaaaaaaaaaaaaa

SEQ ID NO: 236 - protein, 509 aa, Zea mays
MDGSSKGSGHSEALRNYNLGRTLGIGTFGKVKIAEHKLTGHRVAIKIINCRQMRNMEMEEKAKREFKILKLFIHPHIIRLYEVIYTPTDIYVVMEYCKYGELFDYIVEKGRLQEDEARRIFQQIISGVEYCHRNMVVHRDLKPENLLLDSKYNVKLADFGLSNVMHDGHFLKTSCGSPNYAAPEVISGKLYAGPEVDVWSCGVILYALLCGTLPFDDENIPNLFKKIKGGIYTLPSHLSALARDLIPRMLVVEPMKRITIREIREHQWFQIRLPRYLAVPPPDTTQQAKMIDEDTLRDVVNMGFNKNHVCESLCSRLQNEATVAYYLLLDNRFRATSGYLGADYQESMDRNLNQLASSESSSSGTRNYVPGSSDPHSSGLRPYYPVERKWALGLQSRAHPREIMVEVLKALQELNVRWKKNGHYNVKCRWCPGFPEVNDTLDASNSFLGDSTIMDNDDANGRLPTVIKFEFQLYKTKDDKYLLDMQRVTGPQLLFLDFCAAFLTKLRVL

SEQ ID NO: 237 - DNA, 2107 bp, Zea mays
gtcgacccacgcgtccgcccatgtgagcctcgcttttctcctctctctctccccggcatttctctctctggcgtcactcgcgtgtcaggcgcattctgcctctttctttctccccctcccctcccctcccctgcgggcttctctcacgagctcccccggcctcgccgccgccgcctgctccggcgggcgggacccagctcgcagcgtctcccctgcggcgaggtacacgatggagggagcgggaagagatgccaaccctttgagcggttacagaattggcaaaaccctgggaattgggtcgttcggtaaagtgaagatcgcggaacatatattgactggtcataaggtggcgatcaagattctcaatcgcaagaagatcagaagcatggatatggaagagaaagttaagagagaaatcaagatactgagattatttatgcatcctcatatcatacgcctttatgaggtgatagatacacctgctgatatctgtgttgttatggagtatgttaaatctggagagttgtttgattacatcgttgagaagggaaggctacacgaagaggaagcccgacacttttttcagcagatcatatctggtgttgaatattgccataggaacatggttgctcaccgtgatttaaagccagagaatcttcttttggattcaaaatgcaatgttaagattgccgattttggcttaagtaatattatgcgtgatggtcactttcttaagacgagttgtggtagcccgaattatgcagcacctgaggtcatatctggtaaactatatgctggtcctgaagttgacgtctggagctgtggagttattctttatgctcttctttgtggcactctcccatttgacgatgagaatattccaaaccttttcaagaaaataaagggtggaatatatacccttcctagtcatttgtcaccttcagcgagggacttgattcccagaatgctggttgttgatccaatgaaaaggattacaatacgtgaaatccgtgaacatgtgtggttcaagatccgacttccgcgctatttggctgtgccgcctccagacactgctcaacaagttaaaaaggtcgacgaggaaactcttaatgatgttattaagatgggttttgacaagaatcagctaattgaatctctgcaaaacagattgcagaatgaggcaacagttgcctattatttactcttggacaataggcttcgtacaaccagtggttatcttggatctgagtttcaagaatctatggactcatctttgtctcaagtaatcgctgaaacaccaacttcagcaactgaacttcgtcagcatgggttttcagaatctccaggttctggcttgaggcagcattttgcagctgaaaggaaatgggcccttggtcttcagtctcgagcacatccacgagaaataataagtgaagtgcttaaagctctgcaagaactgaatgtttactggaaaaagattggacactacaacatgaaatgcagatggagtcctggctgccttgagagtatgatgcataacagtgatagcttcagtgcggagtctgctataattgaaactgatgttttcatggagaaatcaaccccgacagtgaagtttgagattcagctttacaaaacgagggatgagaagtaccttcttgacctgcaaagggtcagtggatcacatcttctctttctggacttgtgttccgcctttctaactcagctgagagttctttgagcctgacatgattggcttcccaagcactccttgatgcacccagtggagtttcaagttacatttgagatgtacataatgaccatatataatcctccagtagattatattttctggagcatgtaatgtagacgttagaggcttgtcctggtttgccaagatggttgttacctaaggtcctaacaagaggccgcaggcgagcccagtccaattagatgatgtgaaaaatttttggcctttttttagtctttggacatgttatcaaattaaggaggtcgtgctagcacgatacccaaactaagaaataccccattgaaaactgaaaacaaagcttgctcgttcaaaaaaaaaaaaaaaaaaaaaaaaaaa

SEQ ID NO: 238 - protein, 579 aa, Zea mays
STHASAHVSLAFLLSLSPAFLSLASLACQAHSASFFLPLPSPPLRASLTSSPGLAAAACSGGRDPARSVSPAARYTMEGAGRDANPLSGYRIGKTLGIGSFGKVKIAEHILTGHKVAIKILNRKKIRSMDMEEKVKREIKILRLFMHPHIIRLYEVIDTPADICVVMEYVKSGELFDYIVEKGRLHEEEARHFFQQIISGVEYCHRNMVAHRDLKPENLLLDSKCNVKIADFGLSNIMRDGHFLKTSCGSPNYAAPEVISGKLYAGPEVDVWSCGVILYALLCGTLPFDDENIPNLFKKIKGGIYTLPSHLSPSARDLIPRMLVVDPMKRITIREIREHVWFKIRLPRYLAVPPPDTAQQVKKVDEETLNDVIKMGFDKNQLIESLQNRLQNEATVAYYLLLDNRLRTTSGYLGSEFQESMDSSLSQVIAETPTSATELRQHGFSESPGSGLRQHFAAERKWALGLQSRAHPREIISEVLKALQELNVYWKKIGHYNMKCRWSPGCLESMMHNSDSFSAESAIIETDVFMEKSTPTVKFEIQLYKTRDEKYLLDLQRVSGSHLLFLDLCSAFLTQLRVL

SEQ ID NO: 239 - DNA, 2052 bp, Zea mays
ctcccgtcgcggtggtcgctttcggccctggaccccgctgccggaatcgaatctcctcccctcctttctcctccgacctcccccttccccccctccgcggctccgccccgacccgtgtacgcctcgcttcgcacccctctcgcatctccgccgcatctccgccgcgatcctcccgactagccgcgactgcctcccctccagcggccaggcagaggatggagggggcaggcaaggatggcaacccgttgaggaattatcggattggcaagactctcggaattggctcattcgggaaggtgaaaattgcggagcatatcagcactggacacaaggtggcaatcaagattctcaaccgccgtaaaatcagaggcatggagatggaagagaaagttaaaagagagattaagatattgaggttatttatgcatccacatattatccgcctctatgaggttatagacacaccggctgatatttatgttgttatggagtatgttaagtgtggggaattatttgattacattgttgagaaaggtaggctgcaaggaagaagagctcgccgtttcttccaacagattatatccggtgttgaatattgccatagaaacatggtggtgcatcgtgatctaaagccagaaaacctcctattggattcaaaatgcaatgttaagattgcagattttggcttaagtaatgttatgcgggatggtcattttctgaagacaagttgtggtagcccaaattatgctgctcctgaggtgatatctggtaaactatatgctggacctgaagttgatgtgtggagctgtggggttattctttatgctcttttatgtggtactctgccatttgatgacgagaacataccaaacctttttaagaaaataaagggtggaatatatacccttcccagccatttgtctggtgcagcaagggatttgattccaagaatgctagttgtcgatcctatgaagcggatcaccattcgtgaaattcgcgaacatgattggttcaaaattcttctcccgcgctatttgactgtgcctcctccagatagtgcgcaacaagtcaaaaaggttgatgaggaaactctccgtgaggttttaggtatgggatatgacaagaacctgttggtggaatcaatccaaaaaaggctgcaaaatgaggcaactgttgcatattacttactcttggacaataggctccgtacaaccagtggctatcttggagctgaatgtcaagaagctatggactcctcattctcaaacatcgcatcatatgaaacaccaagttcagcacgtgggaatagacagcaaatatttatggagtctccagttggcttgagaccacatcttccagctgagaggaaatgggctcttggtcttcagtctcgagcacatccaaaagaaataatgtctgaagtgctgaaagctctgcaagaattaaatgtttactggaaaaagataggtcactataacatgaagtgcagatggagtcctggctttcctgctcaaattcataacaatcataacttcagtgcagggtccattgaaactgatagcctgagtgagaggttaagtttaattaagtttgaaattcagctgtacaaaacaagagacgagaaatacctcctcgatttgcaaagagtcagtgggccacagctcctctttctggacttgtgcgcggcctttctaactcaactgagagttctttgatttctggtgtcagctttccatcagttgcattccttgcgtttcactagaggaatgtctaaatcgctcacaaagctgtaaatagtaatctccagtagattggattttctggagtatgtagatggtaggcatgagaagatgttatgcctggcggcgatcttctgaaccagactgtgtggagtaacttatctcctaattctttacggctgggccagctgccggtgaattagatcagtgcttttgctggcataatgtctatctacattaataatttcagctattacaacggttaattaaatggctgtgctgcttacaggccaaaaaaaaaaaaaaaaaaaaa

SEQ ID NO: 240 - protein, 570 aa, Zea mays
PVAVVAFGPGPRCRNRISSPPFSSDLPLPPLRGSAPTRVRLASHPSRISAASPPRSSRLAATASPPAARQRMEGAGKDGNPLRNYRIGKTLGIGSFGKVKIAEHISTGHKVAIKILNRRKIRGMEMEEKVKREIKILRLFMHPHIIRLYEVIDTPADIYVVMEYVKCGELFDYIVEKGRLQEEEARRFFQQIISGVEYCHRNMVVHRDLKPENLLLDSKCNVKIADFGLSNVMRDGHFLKTSCGSPNYAAPEVISGKLYAGPEVDVWSCGVILYALLCGTLPFDDENIPNLFKKIKGGIYTLPSHLSGAARDLIPRMLVVDPMKRITIREIREHDWFKILLPRYLTVPPPDSAQQVKKVDEETLREVLGMGYDKNLLVESIQKRLQNEATVAYYLLLDNRLRTTSGYLGAECQEAMDSSFSNIASYETPSSARGNRQQIFMESPVGLRPHLPAERKWALGLQSRAHPKEIMSEVLKALQELNVYWKKIGHYNMKCRWSPGFPAQIHNNHNFSAGSIETDSLSERLSLIKFEIQLYKTRDEKYLLDLQRVSGPQLLFLDLCAAFLTQLRVL

SEQ ID NO: 241 - DNA, 530 bp, Oryza sativa
  unsure (466): n = A, C, G, or T
  unsure (503): n = A, C, G, or T
  unsure (507): n = A, C, G, or T
gagggtaggggactacgtgctggtgcggcagatcgggtcgggggcgtacgcgcgggtctggctcgggaagcaccgcacgcggggcacggaggtggccttgaaggagatcgccgtggagcggcttagcagcaagctccgcgagagcctcctctccgaggtcgacatcctccggcgcatccgtcatcccaacgtcatcgccctccacgagtccatcagggatggtgggaaaatatatcttgtattagagtactgtcgaggtggtgacttacactcataccttcagcagcataaaagggtttctgaaacagttgctaagcatttcatccagcagctagcatctggtctgcagatgctgcgtgaaaacaacgtggttcatcgagatctaaaaaccacagaaattcttctaattgcaaataatgaaaatctccccttgaagattgcggactttggatttgcaaatttttanaaccttcttytctgggctgaaaacactttgcggttcncgcnttaaaagggtccaaaagtcatca

SEQ ID NO: 242 - protein, 151 aa, Oryza sativa
VGDYVLVRQIGSGAYARVWLGKHRTRGTEVALKEIAVERLSSKLRESLLSEVDILRRIRHPNVIALHESIRDGGKIYLVLEYCRGGDLHSYLQQHKRVSETVAKHFIQQLASGLQMLRENNVVHRDLKTTEILLIANNENLPLKIADFGFA

SEQ ID NO: 243 - DNA, 2400 bp, Oryza sativa
gcacgaggagggtaggggactacgtgctggtgcggcagatcgggtcgggggcgtacgcgcgggtctggctcgggaagcaccgcacgcggggcacggaggtggccttgaaggagatcgccgtggagcggcttagcagcaagctccgcgagagcctcctctccgaggtcgacatcctccggcgcatccgtcatcccaacgtcatcgccctccacgagtccatcagggatggtgggaaaatatatcttgtattagagtactgtcgaggtggtgacttacactcataccttcagcagcataaaagggtttctgaaacagttgctaagcatttcatccagcagctagcatctggtctgcagatgctgcgtgaaaacaacgtggttcatcgagatctaaaaccacagaacattcttctagttgcaaataatgaaaattccctcttgaagattgcggactttggatttgcaaagtttttagaaccttcttctctggctgaaacactttgcggttcaccgctttacatggctccagaagtcatgcaagctcagaagtatgatgcaaaggcagatttgtggagtgttggtataattctatatcaacttgttaccggatctcctccttttaccggggatagtcaaatccagttgctgagaaatatactcaatacacgagaaatacgatttccatctgattgcgacttgagccatggctgcattgacttatgcagaaagttactgcgaatcaattcagtggaacgccttaccgttgaagagtttgtgaaccatccatttctcgctgaacatgctttggagagaaccttgagccggacaccatcggacataagagatggctttccattcattaatagcagtcctacgagaccttcaagccaaagttctcaggaagattgtatgccttttcctttggatgatgagtcaactggacaggatgaaggtcctgtttctgatagtaagagtgcaataaaatcctatgggtttgccacgagtaaaaggcttgataaaacttcaggtcagagtccaacgaaacattcaagtctggtctctaaatatattaggggaaataattacgcatctagtagtcaacgcctggaccatcctaggagaatcaaggaaaacaagggtgatgaagggcacaaccctaaaggtggttatccagaagattcccctatcattgattcattagagtttgtagatcaggaatatgtctttgtgcacccagagggatcctcctcttcgatgaatgactcccgacagcgcaccatgccatcaaaacttgacagttcttctctttcaccaccgaagttattaactgctgtgagtgcaccaaggccaatacatggcatggcaattaacagacagcaatctggtggaactggtagcttggacagtcactgctctccagtatctggtacttcacaaggatctgcagatctcaacgatgctatggatcaaccaccatctgattgtctgaccagggttagattattggagcagtatgcgtctaccatagcagaattggtgaaagaaaagattaaagatgccaagcacttagagggattctcgattcagctagttgttcttgcaacctggaagcaagcaatttacatctgcacttcttatgcatcttctgccacaagagagaatccttcccatgatgtcaccgcgaagggttttggctcaaatgctccccatttgcttgcaaactctcaactgttatatgatacatgcatggagatagagagtcagtttttggttcaaatggaatatgctgaagaacttgccaacactataggacagacagttgatgctacagaaatgccagatgcgatagaaatcatatttcagaccgcgcttaacctgggaagacatggtggtgttgatgagatgatggggaaatcagcatctgccatggtgctgtactcgaaggcagtatccatgctgcgctttctcctgactgaggcaccgtcactcgccctgaaccccgctctgtccctaacaagagatgatcgacgccgcctgcgcacatacattgaagccgttaacgctaggctcgtcccgttgcaataccagcggcactgaccgctcacctgtacaatattctttcatcctgtacatatattcgttggcccaaacgagggcgtgtaagatatgtcatgtctgagaacgtgctccgattagggagaagtagcgaaaaatccagtgtaacttgcccaaactgcctactgtaacgtgagctcggtgtgcttgcatggtacgcctgattatcaggcagctcaggttggcagctgaaggcccgaccatggtcgtttgtggacatgtaaagcagactgctacctcgatggtttgttcattaaaatttgggcttttacactgcaaaaaaaaa

SEQ ID NO: 244 - protein, 697 aa, Oryza sativa
TRRVGDYVLVRQIGSGAYARVWLGKHRTRGTEVALKEIAVERLSSKLRESLLSEVDILRRIRHPNVIALHESIRDGGKIYLVLEYCRGGDLHSYLQQHKRVSETVAKHFIQQLASGLQMLRENNVVHRDLKPQNILLVANNENSLLKIADFGFAKFLEPSSLAETLCGSPLYMAPEVMQAQKYDAKADLWSVGIILYQLVTGSPPFTGDSQIQLLRNILNTREIRFPSDCDLSHGCIDLCRKLLRINSVERLTVEEFVNHPFLAEHALERTLSRTPSDIRDGFPFINSSPTRPSSQSSQEDCMPFPLDDESTGQDEGPVSDSKSAIKSYGFATSKRLDKTSGQSPTKHSSLVSKYIRGNNYASSSQRLDHPRRIKENKGDEGHNPKGGYPEDSPIIDSLEFVDQEYVFVHPEGSSSSMNDSRQRTMPSKLDSSSLSPPKLLTAVSAPRPIHGMAINRQQSGGTGSLDSHCSPVSGTSQGSADLNDAMDQPPSDCLTRVRLLEQYASTIAELVKEKIKDAKHLEGFSIQLVVLATWKQAIYICTSYASSATRENPSHDVTAKGFGSNAPHLLANSQLLYDTCMEIESQFLVQMEYAEELANTIGQTVDATEMPDAIEIIFQTALNLGRHGGVDEMMGKSASAMVLYSKAVSMLRFLLTEAPSLALNPALSLTRDDRRRLRTYIEAVNARLVPLQYQRH

SEQ ID NO: 245 - DNA, 1848 bp, Glycine max
ggaatgcagagaaatgagaattgggcattggctcagtccttctgaggcaggtggcgctgccaaacgcagaacctccggcagaaattgccaccgcaaacacgtggaagacgggtagtagtactccatctcccattctctcatattccctttactaattaaagatcatgaacagcgagagacagtcgacgacgacgacgttgctgcacggcaagtacgagctaggtcgtgtgctggggcacggaagcttcgccaaggtctaccacgcgcggaacctgaagacggggcagcacgtggctatgaaggtcgttggaaaagaaaaggtgatcaaggtcggaatgatggagcaggtcaagagggagatctcggtcatgaagatggtcaagcacccaaacatcgtcgagctccacgaagtcatggccagtaagtccaagatctacatctccatcgaactcgtccgcggcggagagctcttcaacaaggtctccaagggacgcttgaaggaggacctggccagactctacttccagcagttaatctctgccgtcgatttctgccacagccgcggcgtctaccaccgtgacctcaagccggagaatctcctcctggacgaacacggcaacctcaaggtctccgacttcggactcaccgccttctccgaccaccttaaagaggacgggctgttacacaccacgtgcggcacgcctgcgtacgtgtcaccggaagttattgcaaagaaaggctatgacggtgccaaggctgatatatggtcatgcggagtaatcctctacgttctcctagctgggtttttaccctttcaggatgataatttggttgccatgtataaaaaaatccatagaggggacttcaagtgcccaccgtggttctctctcgatgcgagaaagcttgttacgaaactgcttgatccgaatccgaatacgaggattagtatttctaaagtgatggagtcttcttggtttaagaaacaggtgccgaggaaggtggaggaggtggttgagaaggtcgatttggaggagaagattgagaatcaggagacgatgaatgctttccacataatctccttgtcggaggggttcaatttgtcgccgttgttcgaggagaagaggaaggaggagatgaggttcgccaccgcggggacgccgagcagcgtcatttcgcgcctggaggaggtggccaaggcggggaagtttgacgtgaagagtagcgagacgaaagtgaggcttcagggacaggagcgtgggaggaaggggaagctagcgattgcggcggatatctacgccgtgacgccgtcgtttatggtggtggaggtcaagaaggacaatggggatacgttggagtataaccagttctgcagcaaacaacttcgtcctgcgcttaaggatatcttctggaattctgcacctgccagtgcttgaatggtatattatatatatgatgtctgattattgttttacaacaccatttgtcgaccttgttattttattttatttttgtttaggaactttgagttttgttgataagatctgtttgtgttttgttgtttaaattgttagtttggtacttggggactggttagtgggtacttactctctctgtcgcccagaattgttgttaagagatgcacacgttgtggatgattctgtcatgtttgtgtttcaattatgagtgtgtaatttggagtgcttgtggggcttactgcgactttgttcaaagttactttttacctttttcttttctttattttattccttctagattatgtcctctgtgttcacgggtcacgcctgtacctaatacactaggaattcgactaaaaaaaaaaaaaaaaaa

SEQ ID NO: 246 - protein, 422 aa, Glycine max
MNSERQSTTTTLLHGKYELGRVLGHGSFAKVYHARNLKTGQHVAMKVVGKEKVIKVGMMEQVKREISVMKMVKHPNIVELHEVMASKSKIYISIELVRGGELFNKVSKGRLKEDLARLYFQQLISAVDFCHSRGVYHRDLKPENLLLDEHGNLKVSDFGLTAFSDHLKEDGLLHTTCGTPAYVSPEVIAKKGYDGAKADIWSCGVILYVLLAGFLPFQDDNLVAMYKKIHRGDFKCPPWFSLDARKLVTKLLDPNPNTRISISKVMESSWFKKQVPRKVEEVVEKVDLEEKIENQETMNAFHIISLSEGFNLSPLFEEKRKEEMRFATAGTPSSVISRLEEVAKAGKFDVKSSETKVRLQGQERGRKGKLAIAADIYAVTPSFMVVEVKKDNGDTLEYNQFCSKQLRPALKDIFWNSAPASA

SEQ ID NO: 247 - DNA, 2123 bp, Glycine max
cgcgatgctttgttcctcttttgttcttccccttcccaatcttcaactttagggttcctttaatctcgttattcctcttcactcccaagctccgttcactccaacaacactccgatttagaaatggatggaccagctggccgaggtggtgctggcctggacatgtttctaccaaattataaattgggaaaaacactcgggattggatcttttggcaaggtgaaaattgcagaacatgtgttgactggccataaggttgcgatcaagatccttaaccgacgcaagataaagaacatggaaatggaagaaaaagtgagaagagaaatcaaaattttaagattgttcatgcatcctcacattattcgactttatgaagtcatagaaactccaactgacatatatgttgtcatggagtatgtgaagtctggagagcttttcgattacatagtagagaagggtaggttgcaggaagatgaagctcgtaatttttttcagcagataatctctggggtggagtactgtcacaggaatatggtggttcatagagatttgaagcctgagaatttacttttggactccaaatgtaatgtcaagattgctgattttggcttgagcaacatcatgcgtgatggtcactttcttaaaacaagttgtggaagccctaactatgcagctcctgaggttatctctgggaaattgtatgctggacctgaagtggatgtctggagctgtggtgtaattttatatgcccttctttgtggcacccttccttttgatgatgaaaatattccaaatctcttcaagaaaataaagggtgggatttacactcttcccagtcatctatcacccggtgctagagatttgataccagggatgcttgtggttgaccctatgaggagaatgaccatacctgagatccgtcaacacccatggttccaagctcgacttccacgttatttagctgtgccaccaccagatacaatgcaacaggccaaaaagattgatgaggagatccttcaggaagtggtgaaaatgggatttgacaggaatcaattggttgaatctcttgggaacaggatacaaaatgagggtactgtggcatactatttgttattggacaaccgatttcgtgtttccagtggctatcttggagctgagtttcaagagaccatggattccggttttaatcaaatgcattccagtgaacttgcttcttcagttgttggaaaccgctttccaggctacatggaatatccaggagtaggatcgaggcaacagttccctgttgaaaggaaatgggcccttgggcttcagtctcgagcccatcctcgtgaaataatgactgaggttcttaaagctttgcaagaattaaatgtttgttggaagaagattggtcactacaacatgaagtgtaggtgggttgctggcattcctggtcaccacgaaggaatggttaacaataatgtgcatagtaatcattactttggagatgattccaacattattgagaatgatgctgtttctacttcaaatgtggtcaagtttgaagtgcagctttacaaaacccgggaagaaaagtatctgcttgatcttcaaagggtgcagggtccacagtttcttttcttggatctatgtgctgctttccttgcacagcttcgtgtcctctagagcgaagagcttaggctcaccagagacataaatatgccttgtgtttcatgtgaataagcttacattgtacatacaagtatcttttcggtccaagcttatcctctgttttctacccgtttatctgtgggtaaacattataatgagccaatcccaagtatgggatttgcttcgttaacaatggtgctcgactaggttttcctttctcttggtgattttaattttatcagtgtaatgaattatatggggaatgtcttaaaagaattagccccaactgacagtgatatatgtatggttatcaaccaaatgctgtaaacgactgttgccattggaagggatgtctaggctgcttctaacttttgcagattagtctttgttgtcctataaatgtaatttcatattactcgtgtatgaatgctatgtaacgactgtgttcatccgaaaaaaaaaaaaaaaaaa

SEQ ID NO: 248 - protein, 514 aa, Glycine max
MDGPAGRGGAGLDMFLPNYKLGKTLGIGSFGKVKIAEHVLTGHKVAIKILNRRKIKNMEMEEKVRREIKILRLFMHPHIIRLYEVIETPTDIYVVMEYVKSGELFDYIVEKGRLQEDEARNFFQQIISGVEYCHRNMVVHRDLKPENLLLDSKCNVKIADFGLSNIMRDGHFLKTSCGSPNYAAPEVISGKLYAGPEVDVWSCGVILYALLCGTLPFDDENIPNLFKKIKGGIYTLPSHLSPGARDLIPGMLVVDPMRRMTIPEIRQHPWFQARLPRYLAVPPPDTMQQAKKIDEEILQEVVKMGFDRNQLVESLGNRIQNEGTVAYYLLLDNRFRVSSGYLGAEFQETMDSGFNQMHSSELASSVVGNRFPGYMEYPGVGSRQQFPVERKWALGLQSRAHPREIMTEVLKALQELNVCWKKIGHYNMKCRWVAGIPGHHEGMVNNNVHSNHYFGDDSNIIENDAVSTSNVVKFEVQLYKTREEKYLLDLQRVQGPQFLFLDLCAAFLAQLRVL

SEQ ID NO: 249 - DNA, 2040 bp, Glycine max
acttagtgctattcaataattacgaaaaaccaacagcgagtgttgtttttgtttggtccaggctggaccagggaatgaatagagatgagaggctttcggttgaagagaactgagttaagcggcgaagccaaacgcagaatcggcggcagaaattgccaccggaagcacgtcgaagacgggtgaaccaaacacaaaattccatccaccacttctcttttcaatccccaactcaaatctgtgaagaaaatctcaatttctaaattgtaattcttagcactactgctagtagtagtaaaaaaaaacaattagaaagtagtagagtgtttttttttctttttttcgtttgttttacttttaagatgggtgagaagagcaacgttggcggcgacgcgattaacacgacactgcttcacgggaagtacgagctgggccggctgttaggccacggaaccttcgcgaaggtgtaccacgcgcgccacctgaagacgggaaagagcgtggcgatgaaggtggtgggcaaagagaaggtggtgaaggtaggcatgatggagcagatcaagagagagatctcagccatgaacatggtgaagcacccaaacatcgtgcagcttcacgaggtcatggcgagcaagtccaagatctacatcgccatggagctcgtccgcggcggcgagctcttcaacaagatcgccagaggccgtctccgggaggagatggccagactttacttccaacaactcatctctgctgtggacttctgccacagccgcggcgtctaccaccgtgacctcaagccagagaaccttctcctcgacgacgacggcaacctcaaggtcaccgacttcggcctcagcactttctccgagcacctccggcacgacggcctgctgcacactacgtgcggcacgccggcctatgtcgcgcccgaggtgattgggaaaagaggctacgacggcgccaaggccgatatttggtcttgtggcgtaatcctctacgtacttcttgctggttttttacccttccaggatgacaacctggtggccttgtacaagaaaatttaccgcggtgacttcaagtgtccgccgtggttctcctccgaggcgcggaggctcatcaccaagctcctcgaccccaacccgaacacgcgaatcacaatttcaaaaatcatggactcgtcgtggttcaagaaacccgtgccgaagaacttgatgggaaagaaaagagaggaattggatctggaggagaagattaaacagcatgagcaggaggtttctactacgatgaatgcttttcacatcatttcgctctcggaggggttcgatttgtcgccgttgttcgaggaaaagaagagagaagagaaagagttacggtttgcgaccacgcgccccgcgagcagcgtgatttcgagattggaagatttggcgaaggcggtgaagttcgacgtgaagaagagcgagactaaggtgaggttgcagggtcaagaaaaagggcgaaaaggtaaactcgctattgctgcggacttgtacgccgtgacgccgtcgtttttggtggtggaggttaagaaggacaacggtgacaccttggagtataaccagttctgtagcaaggagcttcgtccagctcttaaagatatcgtgtggaggacttctcctgcagagaatcctacactcgcttgaagaacaaccaagactcccatgctaattgtcgttcctttgtagttgtttttgttaattcttgtttcaggactgagatattttagttatttgcttgcttctttgttatgttttggcctctggggtgtgtcgtcttttaccccgaaaggggaattgttgaaaaggcgaatgcagtaatgaaccgaaatggacatcgaggagttgttgtcgatgatgattcaggtacatgtgctgcgtgttgttgtgctcgtgggtgatgttgttgctatgttggcgtgattgtgaatatgtttgcaaattgattggtgtggctcatgggtcattcatggctgcgtttaaaaaaaaaaaaaaaaaaaaaaaaaaaaaa

SEQ ID NO: 250 - protein, 438 aa, Glycine max
MGEKSNVGGDAINTTLLHGKYELGRLLGHGTFAKVYHARHLKTGKSVAMKVVGKEKVVKVGMMEQIKREISAMNMVKHPNIVQLHEVMASKSKIYIAMELVRGGELFNKIARGRLREEMARLYFQQLISAVDFCHSRGVYHRDLKPENLLLDDDGNLKVTDFGLSTFSEHLRHDGLLHTTCGTPAYVAPEVIGKRGYDGAKADIWSCGVILYVLLAGFLPFQDDNLVALYKKIYRGDFKCPPWFSSEARRLITKLLDPNPNTRITISKIMDSSWFKKPVPKNLMGKKREELDLEEKIKQHEQEVSTTMNAFHIISLSEGFDLSPLFEEKKREEKELRFATTRPASSVISRLEDLAKAVKFDVKKSETKVRLQGQEKGRKGKLAIAADLYAVTPSFLVVEVKKDNGDTLEYNQFCSKELRPALKDIVWRTSPAENPTLA

SEQ ID NO: 251 - DNA, 2543 bp, Glycine max
caatgctctcttcttccattttccttctcaatccaccactctaaccctcgcacgcttcgttcaattacaaaaatggacagatcaactggccgtggtggtggtggaagtgtggacatgtttctccgaaattataagttgggaaaaacactcggcattgggtcctttggcaaggtgaaaattgctgagcatgtacggactggtcataaagttgctataaagatccttaaccgccacaagattaaaaacatggaaatggaagaaaaagttagaagagaaatcaaaattttaagattgtttatgcatcatcacattataagactatatgaggttgtagaaaccccaacagacatatatgttgttatggagtatgtgaaatctggagagctctttgattacatagtagagaagggtcggctgcaagaggatgaagcccgtcatttttttcagcagataatttctggtgtggagtactgtcacaggaatatggtggttcatagagacctgaagcctgagaatttactcttggactcaaaatttaacatcaagattgctgattttgggttgagcaacatcatgcgtgatggtcactttcttaagacaagttgtggaagccctaattatgcggctccagaggttatctctggaaaattgtatgctggaccagaagtagatgtctggagctgtggtgtaattttatatgctcttctctgtggcactcttccttttgatgatgaaaacattcccaatctcttcaaaaaaataaagggtgggatatacactcttcctagtcatctatcacctggtgctagagatttgataccaaggatgcttgtggtggatcccatgaagaggatgaccatacctgagatacgccaacacccatggttccaagttcatctaccgcgttatttagcagtgccaccaccagatacactgcaacaagccaaaaagattgatgaggagattcttcaggaagtggttaatatgggatttgacaggaatcaattggttgaatctcttagcaacaggatacaaaatgagggtactgtaacatactatttgttattggacaaccggtttcgtgtttctagtggttatcttggagctgaatttcaagagacaatggattctggttttaaccgtatgcattccggcgaagttgcttctccagttgttggacaccacagcacagggtatatggattatcaaggggtaggaatgcggcaacagttccctgttgagagaaaatgggcccttgggcttcagtctcgagcccaaccacgtgaaataatgactgaggtccttaaagctctacaagaattaaatgtttgttggaagaagattggacactataacatgaagtgcagatgggttgctggcactgctggtcatcatgaaggaatgattaacaattctctgcatagtaatcattactttggaaatgattccggcattattgaaaatgaagctgtttctaagtcaaatgtggtcaagtttgaagtgcagctttacaaaactcgtgaggagaaatatctgcttgatcttcaaagggtccagggcccacagtttcttttcttggatctgtgcgctgctttcctttcacagctacgtgttctctagtgaagctcacaagtcgcaaaggagaccttgaggtgtcttgtgtggcatgtgaataagcttacgttgtacatatcaatgccctttcagtatgggtatatctatctgtttgtactttttagcatacccccagtttttatgggttatcatgattggggaaacctaaatatggaatttgctttccttaatcatggtgtctgactaggtctgtctttttaaaagtgaattgaattttcttgatcccgtgaaatccctgaggattttatgaaagcattcgcctccaacagagacatccatttatggtattgaattttgtgttgtaattgactacttatgtctgtcacttggaagccgaggggttgtttgcctaggctgcatcgaacatgagcttgcagataagcattttctccccgcttccctacttaattactgcctcctcttatggatgcatgttatttgacaaaaaaaaaaatctgaatggaaaagaaaagcgtcaccgtgcagatccgtgattgagcaaaacgacgtcgtgctgctacgcatcgcatcgaagttgcaacaatggcgagttccgaatcgcaagagcatcatccatggatctcgaatgcagttcctttgttggtggttcttctaattgcacttcacgtcttcgctttggtgtattggatttatagattggccactgacaataagccacaacagcagcagcagctacaacaacagcaacagcaacatcaacagagaacaaaggctcactgaccgacaacaacaacaacaacaacaacaaacgttctcattcaatttcattttcttcaaacaattgttgtatgaaattgttaattgtgtgcagtaaaggatatgatttttttgtttttttggtataacagtgatgaatgaagttttgtttaatttttaaaaaaaaaaaa

SEQ ID NO: 252 - protein, 515 aa, Glycine max
MDRSTGRGGGGSVDMFLRNYKLGKTLGIGSFGKVKIAEHVRTGHKVAIKILNRHKIKNMEMEEKVRREIKILRLFMHHHIIRLYEVVETPTDIYVVMEYVKSGELFDYIVEKGRLQEDEARHFFQQIISGVEYCHRNMVVHRDLKPENLLLDSKFNIKIADFGLSNIMRDGHFLKTSCGSPNYAAPEVISGKLYAGPEVDVWSCGVILYALLCGTLPFDDENIPNLFKKIKGGIYTLPSHLSPGARDLIPRMLVVDPMKRMTIPEIRQHPWFQVHLPRYLAVPPPDTLQQAKKIDEEILQEVVNMGFDRNQLVESLSNRIQNEGTVTYYLLLDNRFRVSSGYLGAEFQETMDSGFNRMHSGEVASPVVGHHSTGYMDYQGVGMRQQFPVERKWALGLQSRAQPREIMTEVLKALQELNVCWKKIGHYNMKCRWVAGTAGHHEGMINNSLHSNHYFGNDSGIIENEAVSKSNVVKFEVQLYKTREEKYLLDLQRVQGPQFLFLDLCAAFLSQLRVL

SEQ ID NO: 253 - DNA, 1869 bp, Glycine max
gcacgaggtctggttgcatagcattggttggtagttgtctcaaaaatctcttcttgccctttggccataatcaaaagccaagacactgttcatacagctgctcaattatcaagccaaccttgctcggttccactgcagaatttcagtttattcttatctagctcaattctggttgtgggtttatctcttactggaagacagactttgaggtagactccttataagtgcgcagaagttcaagtgtagagaatgagtcagcctaagattaaacgccgagttggtaaatacgaggtggggaggaccattggtgaaggtacatttgcaaaggtgaaatttgcaaggaactctgagacaggagagcccgtggctcttaaaattcttgacaaggagaaggtgctaaagcacaagatggctgagcagatcaggagagaagtagctacaatgaaactaatcaagcatccaaatgttgttcgattgtatgaggtcatgggaagcaagaccaaaatatatattgttttggagtttgtaactgggggggaactctttgacaaaattgtaaaccatggaaggatgagtgaaaatgaagcacgtagatatttccagcagcttataaatgctgttgattattgccatagcaggggtgtctaccacagagacctgaagccagaaaatttgctattagatacttatgggaaccttaaagtttctgattttggtttgagtgccctctcccagcaagttagggatgatggacttcttcatactacatgtggcactccaaattatgttgctcctgaggtccttaacgatagaggctatgatggggcaactgcagacttgtggtcatgtggggttattctctttgtattggttgcaggttacttgcctttcgacgaccctaatcttatgaacctgtataaaaagatctcagctgctgaatttacttgccccccatggctttctttcactgccaggaaattgattacacgaatcttggatccagatcccaccactcgtatcactatacctgagattttggatgatgaatggtttaagaaagaatataagcctcccatttttgaggagaatggggaaatcaacctcgatgatgttgaagctgtctttaaagactctgaagagcaccatgtgacagagaaaaaagaagagcagcctacagccatgaatgcatttgagttaatctccatgtccaaaggactgaaccttgaaaacttgtttgatactgagcagggatttaaaagggaaacaagattcacctcaaaatcccctgcggatgagataatcaacaagattgaggaagccgcaaaacctcttggctttgatgtgcagaagaaaaattacaagatgaggcttgcaaatgtgaaagctggaaggaagggaaaccttaatgttgccacagagatatttcaagtggcaccttctcttcacatggtagaggtacggaaggcaaaaggagatacattggagttccataagttctacaagaaactttcaacaagcctggatgatgttgtttggaaaacagaagatgatatgcaaatgcgagaaacaaagtgatgtggatattattatcattgtctattaagtgtaattttcttcgtgtctgaggttttactattttccaatttcttcattcgttatattcctcccccgtaggtttgtttggacattaattacatagtactcatttattgcataccatgctattattttttgaaagcatgcagagttcatgtaagaattttactcatccaacagtcgcggttatgttcatgaaacaaaaaattgtaagaaatttgtatattgtatatatctatctatttatatcttttcaaaaaaaaaaaaaaaaaa

SEQ ID NO: 254 - protein, 441 aa, Glycine max
MSQPKIKRRVGKYEVGRTIGEGTFAKVKFARNSETGEPVALKILDKEKVLKHKMAEQIRREVATMKLIKHPNVVRLYEVMGSKTKIYIVLEFVTGGELFDKIVNHGRMSENEARRYFQQLINAVDYCHSRGVYHRDLKPENLLLDTYGNLKVSDFGLSALSQQVRDDGLLHTTCGTPNYVAPEVLNDRGYDGATADLWSCGVILFVLVAGYLPFDDPNLMNLYKKISAAEFTCPPWLSFTARKLITRILDPDPTTRITIPEILDDEWFKKEYKPPIFEENGEINLDDVEAVFKDSEEHHVTEKKEEQPTAMNAFELISMSKGLNLENLFDTEQGFKRETRFTSKSPADEIINKIEEAAKPLGFDVQKKNYKMRLANVKAGRKGNLNVATEIFQVAPSLHMVEVRKAKGDTLEFHKFYKKLSTSLDDVVWKTEDDMQMRETK

SEQ ID NO: 255 - DNA, 1899 bp, Triticum aestivum
gcacgaggcgctctcgtcgcctccccacccattccagcggttgaccgcgggattcggccagtgaaaatggaagggaacactagaggaggtgggcattctgacgcattaaagaactacaatgtgggcagaacattaggtataggcacatttggaaaagtgaggattgcagagcataagcatacagggcataaagttgctataaagattctgaaccgtcgtcaaatgagaactatggaaatggaggagaaagcaaagagagagatcaagatattgaggttgttcatccaccctcatatcatccggctttatgaggtcatttacacacctacagatatatttgttgtgatggaatattgcaagtatggtgagctattcgactgcattgttgagaaagggcggttacaggaagatgaggctcgtcgaatcttccagcagattatatctggtgttgaatactgccacagaaacatggttgctcatcgtgatctaaagccagagaacctgttacttgattccaaatacaatgtgaaacttgccgactttgggttaagtaatgtcatgcatgatggccattttctgaagactagctgcgggagtccaaactatgctgcaccagaggttatctcaggtaaattatacgctggacctgaggttgatgtttggagctgcggggtgatactttatgctcttctttgtggcactcttccatttgatgatgacaatattcccaaactgttcaaaaagataaagggaggcatctatatccttccaagtcatttatctgctcttgcaagggatttgatcccaagaatgcttgttgttgatcctatgaagagaatcacaattcgtgaaattcgagaacacccatggtttcagaatcgccttcctcgctacctggcagtgcctccaccagacacggcgcagcaagccaaaatgattgatgaagatacacttaaagagattgtcaacctgggatatgataaagaccatgtgtgtgaatcattgtgcaataggctgcaaaatgaggcaactgttgcatattacttactcttggacaatcggttccgggccactagtggctatttgggggctgactatctacaatcaatgggtaggagttttaatcagtttacttcattggaatcagcaagcccaagtaccaggcagtatcttccagcaagcaatgattctcaaggcagtggcttgcggccatattaccccgttgaaagaaaatgggctcttgggctccagtctcgagctcaacctcgtgagataatgatcgaggttctaaaggcacttcaagaattaaatgtctgctggaagaagaatggacactacaacatgaaatgcaggtggtgccctgggtttcctcaggtcagtgatatgttagatgccaaccacagctttgttgatgactctaccatcatggataacggcgatgctaatgggaggctacctgccgtgatcaagtttgaaatccagctttacaagaccaaggatgacaagtacctgctagatatgcagagagttactggacctcagctcctcttcctggatttttgcgcggccttccttaccaaccttagggttctatagtatggtgcctgttctggttgagtgatgaatagtgagacatatgaccgtcagcgatgaataagttggtgcctgttctggttgagtgatgaatagtgagacatgtgactgtcagagatgaataagtgatggtgtgtaaataggtggtgtgtttcatcttcgttttacccagtccctgacagcgaaccgtgttgtttgggtgactagtcctgtgtgaagcaccaaaagtgttgtttgggtgaaaaaaaaaaaaaaaaaaaaaaaaaaaaaaaaaaaaaaaaaaaaaaaaaaaaaaaaaaaaaaaaa

SEQ ID NO: 256 - protein, 531 aa, Triticum aestivum
ARGALVASPPIPAVDRGIRPVKMEGNTRGGGHSDALKNYNVGRTLGIGTFGKVRIAEHKHTGHKVAIKILNRRQMRTMEMEEKAKREIKILRLFIHPHIIRLYEVIYTPTDIFVVMEYCKYGELFDCIVEKGRLQEDEARRIFQQIISGVEYCHRNMVAHRDLKPENLLLDSKYNVKLADFGLSNVMHDGHFLKTSCGSPNYAAPEVISGKLYAGPEVDVWSCGVILYALLCGTLPFDDDNIPKLFKKIKGGIYILPSHLSALARDLIPRMLVVDPMKRITIREIREHPWFQNRLPRYLAVPPPDTAQQAKMIDEDTLKEIVNLGYDKDHVCESLCNRLQNEATVAYYLLLDNRFRATSGYLGADYLQSMGRSFNQFTSLESASPSTRQYLPASNDSQGSGLRPYYPVERKWALGLQSRAQPREIMIEVLKALQELNVCWKKNGHYNMKCRWCPGFPQVSDMLDANHSFVDDSTIMDNGDANGRLPAVIKFEIQLYKTKDDKYLLDMQRVTGPQLLFLDFCAAFLTNLRVL

SEQ ID NO: 257 - DNA, 2006 bp, Triticum aestivum
ctccgcgccgccgctgccgctacgcctctccccgggaagcctcgccggcggccaggtggaagatggagacaggcggcaaagatggcaaccctttgaagaattaccgtattgggaagaccctggggattggttcgttcgggaaggtcaagattgccgagcatataaaaactggtcacaaggtggccgtcaagatccttaaccgccggaaaatcaaaaacatggagatggaagagaaagtgaaaagagagatcaagatattaagattattcatgcacccacatatcatccgcctttatgaagtgatagaggcaccagctgatatttatgtggttatggagtatgttaagtctggtgaattgtttgattacattgttgagaaaggtaggctacaggaggaagaggcccgccgtttctttcaacagatcatatctggtgttcaatattgccacaggaacatggtggtgcaccgcgatctaaagccggagaaccttcttttggacaataattgtgatgttaagattgcggattttggcttaagtaatgttatgcgtgacggccactttcttaagacaagttgtggtagcccaaattatgcagctccggaggttatatctggaaaactgtacgctgggcctgaagttgatgtatggagctgcggtgttattctttatgctcttctatgtggtactcttccatttgatgatgagaacatacccaacctttttaagaaaataaagggtggaatatatacccttccaagccatttatcaggcccagcaagggatttgattccaaggatgctagttgttgatcctatgaagaggataaccattcgtgaaatacgcgagcatccatggtttgaagctcaactcccacgatatttagccgtgcctccaccagatactgcacaacaagttaaaaagattgatgaagaatctcttgttaaagttatcagtctgggatttgacaaaaacctgctggttgaatcaattcataatagattgcaaaatgaggcaacagttgcatattatttgtttttggataataagagtcgcacaacaactggctatcttggagctgggtatcaagaagctatggaatcgtctttctcacccattactccaagtgaaacacaaagtccagctcatggaaatcggcaacaaccatatatggaatctccagttggcttgagaccacattttccagctgataggaaatgggctcttgggcttcagtctcgagcacatccaagagaagttatgactgaagtgctgaaggctctgcaagaactgaatgtatactggaaaaaaattggacactataacatgaaatgtagatggagtcctcctggctttcccggtcaggagaatatgaatcataccaattataacttcagtgcagagcctattgaaaccgacgacctgggtgacaagttaaatttaattaagttcgaacttcagctttacaaaacaagagatgagaaataccttctggatttgcaaagggcgagcgggccgcatctcctctttcttgatctatgtgccgcctttctagctcagctgagagtcttttgataccagatgtgcccgaggaatgtatgttgtatcactctaaagagatgtaaatagcaagctttctccagcggatcaaagtcgtggagtatgtagacatgcggagctgttgtgtgcttatttcggcgcctatatgctgaatttagacctggcaggggcgggcaagtgaagcaagcaaggaactattgccatcaggttatttccagctgccgccaaaggcactaggatatagaagtattactgattaatcctatattggccccttgggacatactcctactctactgctgtttacttgcatgtaatttttactgtctgggtctccagaccagaccacgtacacgaataatttcttcaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 258 - protein, 523 aa, Triticum aestivum
PRRRCRYASPREASPAARWKMETGGKDGNPLKNYRIGKTLGIGSFGKVKIAEHIKTGHKVAVKILNRRKIKNMEMEEKVKREIKILRLFMHPHIIRLYEVIEAPADIYVVMEYVKSGELFDYIVEKGRLQEEEARRFFQQIISGVQYCHRNMVVHRDLKPENLLLDNNCDVKIADFGLSNVMRDGHFLKTSCGSPNYAAPEVISGKLYAGPEVDVWSCGVILYALLCGTLPFDDENIPNLFKKIKGGIYTLPSHLSGPARDLIPRMLVVDPMKRITIREIREHPWFEAQLPRYLAVPPPDTAQQVKKIDEESLVKVISLGFDKNLLVESIHNRLQNEATVAYYLFLDNKSRTTTGYLGAGYQEAMESSFSPITPSETQSPAHGNRQQPYMESPVGLRPHFPADRKWALGLQSRAHPREVMTEVLKALQELNVYWKKIGHYNMKCRWSPPGFPGQENMNHTNYNFSAEPIETDDLGDKLNLIKFELQLYKTRDEKYLLDLQRASGPHLLFLDLCAAFLAQLRVF

SEQ ID NO: 259 - DNA, 629 bp, Amaranthus retroflexus
  unsure (566)..(567)..(568): n = A, C, G, or T
  unsure (606)..(607)..(608): n = A, C, G, or T
  unsure (626)..(627)..(628)..(629): n = A, C, G, or T
gcacgaggatggatcatcatcatcgtggagggttccatggttaccgcaaacaacatcccctttctaagtcctcctcttctgaaatgagattgacatcggaggtgttaccggctgagatgaatcacatacgcccaactagcaatggaaaaggagtatcacatgacatgaacaaccataccaataaccatcatccctacaacaatagcaacaacaacaacaatggtttcagcaacggaaatagtaatcactcagcatcaaccgatcaagataacaatgagtgcactgtacgcgagcaagatcgctttatgcccatcgccaatgtcattaggatcatgcgcaagattcttcctcctcatgccaaaatctccgatgatgctaaggaaactatccaggagtgtgtatcagagtacatcagcttcataacaggtgaagccaacgagaggtgccaaagggaacaacgtaagaccataactgctgaagatgttctttgggcgatgagcaagttgggattcgatgactacatcgaacccctcacactgtacttgcatcgatacagggaactcgannnggaacgtggttccatccgcacttgtgagccactcctcnnnctcagtcgtgctgccatnnnn

SEQ ID NO: 260 - protein, 198 aa, Amaranthus retroflexus
  UNSURE (186)..(187): Xaa = any amino acid
MDHHHRGGFHGYRKQHPLSKSSSSEMRLTSEVLPAEMNHIRPTSNGKGVSHDMNNHTNNHHPYNNSNNNNNGFSNGNSNHSASTDQDNNECTVREQDRFMPIANVIRIMRKILPPHAKISDDAKETIQECVSEYISFITGEANERCQREQRKTITAEDVLWAMSKLGFDDYIEPLTLYLHRYRELXXERGSIRTCEPL

SEQ ID NO: 261 - DNA, 625 bp, Momordica charantia
  unsure (597)..(598)..(599): n = A, C, G, or T
  unsure (620)..(621)..(622)..(623): n = A, C, G, or T
gcacgaggctagctagctaggtctctctactcagttagagagagaaagaaaaagaaaacaaggggaagagagagagagaggcatggaatatggaggaggaggaggagatgggttccatagctacagaaggcagcagccaaacacaaaaccaagctctgctttgaacatgttgctgaccacaaacaagccatccgccaacaaccaccaccaccacttaaacggccaaaacgccaccaccaccaccaactcctctgctgctgccgccccgaccctggccccggccgctgctgccaacaacaacgagcagcagtgcgtcgtgcgggagcaagaccaatacatgccgatcgccaacgtgatacgcatcatgcggcggatcttaccctcccatgcaaagatatccgacgatgccaaggagaccatccaagagtgtgtgtcggagtacattagcttcatcaccggcgaggccaacgagcggtgccagcgagagcagcgcaagacggtgacggcggaggacgtcctttgggccatggggaagcttggcttcgacgactacatcgagccactcaccgtgttcctcaaccgctaccgggagtcagnnngcgatcgaatccgaacggagnnnntc

SEQ ID NO: 262 - protein, 179 aa, Momordica charantia
  UNSURE (172)..(173): Xaa = any amino acid
MEYGGGGGDGFHSYRRQQPNTKPSSALNMLLTTNKPSANNHHHHLNGQNATTTTNSSAAAAPTLAPAAAANNNEQQCVVREQDQYMPIANVIRIMRRILPSHAKISDDAKETIQECVSEYISFITGEANERCQREQRKTVTAEDVLWAMGKLGFDDYIEPLTVFLNRYRESXXDRIRTE

SEQ ID NO: 263 - DNA, 1173 bp, Zea mays
ccacgcgtccgccaccacaccacgagcgcgcgataaccctagctagcttcaggtagtagcgagagccaatggactccagcagcttcctccctgccgccggcgcggagaatggctcggcggcgggcggcgccaacaatggcggcgctgctcagcagcatgcggcgccggcgatccgcgagcaggaccggctgatgccgatcgcgaacgtgatccgcatcatgcggcgcgtgctgccggcgcacgccaagatctcggacgacgccaaggagacgatccaggagtgcgtgtcggagtacatcagcttcatcacgggggaggccaacgagcggtgccagcgggagcagcgcaagaccatcaccgccgaggacgtgctgtgggccatgagccgcctcggcttcgacgactacgtcgagccgctcggcgcctacctccaccgctaccgcgagttcgagggcgacgcgcgcggcgtcgggctcgtcccgggggccgccccatcgcgcggcggcgaccaccacccgcactccatgtcgccagcggcgatgctcaagtcccgcgggccagtctccggagccgccatgctaccgcaccaccaccaccaccacgacatgcagatgcacgccgccatgtacgggggaacggccgtgcccccgccggccgggcctcctcaccacggcgggttcctcatgccacacccacagggtagtagccactacctgccttacgcgtacgagcccacgtacggcggtgagcacgccatggctgcatactatggaggcgccgcgtacgcgcccggcaacggcgggagcggcgacggcagtggcagtggcggcggtggcgggagcgcgtcgcacacaccgcagggcagcggcggcttggagcacccgcacccgttcgcgtacaagtagctagttcgtacgtcgttcgacttgagcaagccatcgatctgctgatctgaacgtacgctgtattgtacacgcatgcacgtacgtatcggcggctagctctcctgtttaagttgtactgtgattctgtcccggccggctagcaacttagtatcttccttcagtctctagtttcttagcagtcgtagaagtgttcaatgcttgccagtgtgttgttttagggccggggtaaaccatccgatgagattatttcaaaaaaaaaaaaaaaaaa

SEQ ID NO: 264 - protein, 278 aa, Zea mays
MDSSSFLPAAGAENGSAAGGANNGGAAQQHAAPAIREQDRLMPIANVIRIMRRVLPAHAKISDDAKETIQECVSEYISFITGEANERCQREQRKTITAEDVLWAMSRLGFDDYVEPLGAYLHRYREFEGDARGVGLVPGAAPSRGGDHHPHSMSPAAMLKSRGPVSGAAMLPHHHHHHDMQMHAAMYGGTAVPPPAGPPHHGGFLMPHPQGSSHYLPYAYEPTYGGEHAMAAYYGGAAYAPGNGGSGDGSGSGGGGGSASHTPQGSGGLEHPHPFAYK

SEQ ID NO: 265 - DNA, 1269 bp, Zea mays
ccacgcgtccgcatgaataatccccaaaaccctaaagccagtgctccttgcaccttgccaccggagcttcccaaagaagcagtggcgaccgacgaagcaccgccgccaatgggcaacaacaacaacacggaatcggcgacggcgacgatggtccgggagcaggaccggctgatgcccgtggccaacgtgtcccgcatcatgcgccaagtgctgcctccgtacgccaagatctccgacgacgccaaggaggtgatccaggagtgcgtgtcggagttcatcagcttcgtcactggcgaggcgaacgagcggtgccacaccgagcgccgcaagaccgtcacctccgaggacatcgtgtgggccatgagccgcctcggcttcgacgactacgtcgcgcccctcggcgccttcctccagcgcatgcgcgacgacagcgaccacggcggtgaagagcgcggcggccctgcagggcgtggtggctcgcgccgcggctcgtcgtccttgccgctccactgcccgcagcagatgcaccacctgcacccagccgtctgccggcgtccgcaccagagcgtgtcgcctgctgcaggatacgccgtccggcccgttccccgcccgatgccagccagtgggtaccgcatgcagggcggagaccaccgcagcgtgggcggcgtggctccctgcagctacggaggggcgctcgtccaggccggtggaacccaacacgttgttggattccacgacgacgaggcaagctcttcgagtgaaaatccgccgccggaggggcgtgccgctggctcgaactagcctagcttctcagttccccgtgtacaataagaggggcggtcgcggcgccgcgccgcgcccttgggttgggccgggcgctatgctgcagtttggtttgtaaactaacgagcctagggtagctggtgcacgcgcgccacctcgccggacgtcgccgtcgtcgtcggcatggacttaaccggcgggccctgttgttatttctcaagtttgtagccaacgcactgttcggtgcgttccataatttaatttaccatgttgctctcgaaatgaaaaaaaaaaaaaaaaaaagggcggccgccctttttttttttttttttttttttcctcttaaggcaaggcaactcctgtttgtaggggaatcgttatggttctgcttctgattgctcctagttcttccatcattttcgtgttcaaagagaaggctcccagaaaataaaataacgattgctatgaaaaaaaaaaaaaaaaaag

SEQ ID NO: 266 - protein, 262 aa, Zea mays
MNNPQNPKASAPCTLPPELPKEAVATDEAPPPMGNNNNTESATATMVREQDRLMPVANVSRIMRQVLPPYAKISDDAKEVIQECVSEFISFVTGEANERCHTERRKTVTSEDIVWAMSRLGFDDYVAPLGAFLQRMRDDSDHGGEERGGPAGRGGSRRGSSSLPLHCPQQMHHLHPAVCRRPHQSVSPAAGYAVRPVPRPMPASGYRMQGGDHRSVGGVAPCSYGGALVQAGGTQHVVGFHDDEASSSSENPPPEGRAAGSN

SEQ ID NO: 267 - DNA, 481 bp, Argemone mexicana
  unsure (410): n = A, C, G, or T
  unsure (471): n = A, C, G, or T
cgagagaaagagttggtgaagaagaagaagaagttgaaaagagatggaacgtggtggtggtggtggtggtagtggtggtggtttccatggatatcagaaactcccaaaatcaaactccgctggaatgatgctctcggagctatcgaataacaacaacaatattgacgtaaactctacatgtactgtacgagagcaagatcgatacatgccaattgctaatgtgatcaggatcatgcgtaaggtacttcctactcatgccaagatctctgacgatgccaaagaaactatccaagaatgtgtctcagaatacatcagtttcatcacaagtgaagccaatgatcgttgccaacgtgaacaaagaaagacaatcacagctgaagatgttttatgggcgatgagcaaactagggnttgatgagtacattgaacctctaactctttaccttcaacgttatcgtgagtttgaaggtgnacgttggtca

SEQ ID NO: 268 - protein, 146 aa, Argemone mexicana
  UNSURE (123): Xaa = any amino acid
  UNSURE (143): Xaa = any amino acid
MERGGGGGGSGGGFHGYQKLPKSNSAGMMLSELSNNNNNIDVNSTCTVREQDRYMPIANVIRIMRKVLPTHAKISDDAKETIQECVSEYISFITSEANDRCQREQRKTITAEDVLWAMSKLGXDEYIEPLTLYLQRYREFEGXRWS

SEQ ID NO: 269 - DNA, 1154 bp, Glycine max
  unsure (3): n = A, C, G, or T
atnacacacacctaccttataactatggaaactggaggctttcatggctaccgcaagctccccaacacaacctctgggttgaagctgtcagtgtcagacatgaacatgaacatgaggcagcagcaggtagcatcatcagatcagaactgcagcaaccacagtgcagcaggagaggagaacgaatgcacggtgagggagcaagacaggttcatgccaatcgctaacgtgatacggatcatgcgcaagattctccctccacacgcaaaaatctccgatgatgcaaaggagacaatccaagagtgcgtgtcggagtacatcagcttcatcaccggggaggccaacgagcgttgccagagggagcagcgcaagaccataaccgcagaggacgtgctttgggcaatgagtaagcttggattcgacgactacatcgaaccgttaaccatgtaccttcaccgctaccgtgagctggagggtgaccgcacctctatgaggggtgaaccgctcgggaagaggactgtggaatatgccacgcttgctactgcttttgtgccgccaccctttcatcaccacaatggctactttggtgctgccatgcccatggggacttacgttagggaaacgccaccaaatgctgcgtcatctcatcaccatcatggaatctccaatgctcatgaaccaaatgctcgctccatataaaattaatgaagagtactgttcagtaggagaacaagacttcttggacttgattagcttaactctcagtgattggtgttagagtactgttgttgaggatggttaattttataattaagggctgggaattggggagttagtatatattcctaatcctaattatgtgcatctttaatttatggaataactttgttttttgttttaacttctgataatttggattttctgatgtttaatgtggttttgtctatcccttattaacagtgccaagcttaaggttttagccatgctccaaaatggaatacttgtactgttatgttgttctggtagtgatggtgatgaaacctgcaagttatgtttatgtataaagccactattgatcaaaattagagaaattatcatttaataagtatcctcccatgttaattttaaaaaaaaaaaaaaaaaactcgagaccggca

SEQ ID NO: 270 - protein, 223 aa, Glycine max
METGGFHGYRKLPNTTSGLKLSVSDMNMNMRQQQVASSDQNCSNHSAAGEENECTVREQDRFMPIANVIRIMRKILPPHAKISDDAKETIQECVSEYISFITGEANERCQREQRKTITAEDVLWAMSKLGFDDYIEPLTMYLHRYRELEGDRTSMRGEPLGKRTVEYATLATAFVPPPFHHHNGYFGAAMPMGTYVRETPPNAASSHHHHGISNAHEPNARSI

SEQ ID NO: 271 - DNA, 942 bp, Glycine max
gcacgagctctcttataatcacacacacacctaccttaatagctatggaaactggaggctttcacggctaccgcaagctccccaacaccaccgctgggttgaagctgtcagtgtcagacatgaacatgaggcagcaggtagcatcatcagatcacagtgcagccacaggagaggagaacgaatgcacggtgagggagcaagacaggttcatgccaatcgccaacgtgattaggatcatgcgcaagattctccctccacacgcaaaaatctcggacgatgcaaaagaaacaatccaagagtgcgtgtctgagtacatcagcttcatcacaggtgaggcgaacgagcgttgccagagggagcagcggaagaccataaccgcagaggacgtgctttgggccatgagcaagcttggattcgacgactacatcgaaccgttgaccatgtaccttcaccgctaccgtgaacttgagggtgaccgcacctctatgaggggtgaaccactcgggaagaggactgtggaatacgccacgcttggtgttgctactgcttttgtccctccaccctatcatcaccacaatgggtactttggtgctgccatgcccatggggacttacgttagggaagcgccaccaaatacagcctcctcccatcaccaccaccaccaccaccaccaccatgctcgtggaatctccaatgctcatgaaccaaatgctcgctccatataaaattatataattatgactaggattcagaacaagacttgatgatgattagcttaactctcagtaattggtgctagagtactactgttgttgaggatactttattttataattaagggctgggaagggagttagtatattcctaatcctaactatgtgcatctttaatttatgaaatcactttgttttaacctttgatgaaaaaaaaaaaaaaaaaaaa

SEQ ID NO: 272 - protein, 240 aa, Glycine max
TSSLIITHTPTLIAMETGGFHGYRKLPNTTAGLKLSVSDMNMRQQVASSDHSAATGEENECTVREQDRFMPIANVIRIMRKILPPHAKISDDAKETIQECVSEYISFITGEANERCQREQRKTITAEDVLWAMSKLGFDDYIEPLTMYLHRYRELEGDRTSMRGEPLGKRTVEYATLGVATAFVPPPYHHHNGYFGAAMPMGTYVREAPPNTASSHHHHHHHHHHARGISNAHEPNARSI

SEQ ID NO: 273 - DNA, 796 bp, Glycine max
gcacgagcaatggcgggagtgagggaacaggaccagtacatgccgatagcgaacgtgataaggatcatgcgtcggattctgccagcgcacgcgaagatctcagacgacgcgaaggagacgatccaggagtgcgtgtctgagtacatcagtttcatcacggcggaggcgaacgagcggtgccagcgggagcagcggaagacggtgaccgcagaggatgtgttgtgggcgatggagaagcttggctttgacaactacgctcaccctctctctctttaccttcaccgctaccgcgagagtgaaggagaacctgcttctgtcagacgcgcttcttctgcaatggggatcaataataatatggtgcacccaccttatattaattctcatggctttggaatgtttgattttgacccatcatcgcaagggttttacagggacgatcataacgctgcttctggatctggtggttttgttgcgccttttgatccttatgctaacatcaaacgtgatgccctgtgatcatgtaagaacaacaactagtgcatgctgctttttcacttggttagttatattcaagcacaagcacatgcaggtgcagctgcaactatttagcttcatctacaaatcttttttcctctcttcttctcatgctttaattatttagagacaatacttgttattcattgttatgctcaattgctagcttctattcatcgtcgactgtctgtattgttgatgttcattacagtaacagataagatggtaactgctttactacttcaaaaaaaaaaaaaaaaaa

SEQ ID NO: 274 - protein, 171 aa, Glycine max
ARAMAGVREQDQYMPIANVIRIMRRILPAHAKISDDAKETIQECVSEYISFITAEANERCQREQRKTVTAEDVLWAMEKLGFDNYAHPLSLYLHRYRESEGEPASVRRASSAMGINNNMVHPPYINSHGFGMFDFDPSSQGFYRDDHNAASGSGGFVAPFDPYANIKRDAL

SEQ ID NO: 275 - DNA, 905 bp, Vernonia mespilifolia
gcacgagccaatttctagagagagaacgagagagaattctctaaagaggaaaaatagatggaacgtggaggaggtttccatggctaccacaggctccccatccaccctacatctggaatccaacaatcggatatgaagctaaagctaccagaaatgaccaacaataactcgtccactgatgacaatgagtgcaccgttcgagaacaggaccgcttcatgccgatagcaaacgtgatccgcatcatgcggaagatccttcctccacatgccaagatctctgatgatgccaaagagacgatccaagaatgtgtttcagagtacattagctttgtcacaggcgaggcaaatgaccgctgccagcgtgagcaaaggaagaccatcacagctgaagatgtgctctgggctatgagcaaactgggatttgatgattatatcgagcccttgactgtgtatctccatcgctacagggagtttgatggtggcgaacgtggatccataaggggtgagccccttgtgaagaggagtacttctgatcctggtcactttgggatggcttcttttgtgcctgcttttcatatgggtcatcataacggcttctttggtcctgcaagcattggtggtttcctgaaagacccatcgagtgctggcccttcgggacctgcagtcgctgggtttgagccgtatgctcagtgtaaagagtaactgcaaaaagtaggggttgggatgagatgatgatgatggtggtggtggtggtggtttgttttgttttgttctttcttttttttttcttctttcttttcttggtcattgaggaacaaacttacattggttcactttggctaggcatgtaaacggttaacatgcttatcaagtagtagttttcgatcaaaaaaaaaaaaaaaaaa

SEQ ID NO: 276 - protein, 214 aa, Vernonia mespilifolia
MERGGGFHGYHRLPIHPTSGIQQSDMKLKLPEMTNNNSSTDDNECTVREQDRFMPIANVIRIMRKILPPHAKISDDAKETIQECVSEYISFVTGEANDRCQREQRKTITAEDVLWAMSKLGFDDYIEPLTVYLHRYREFDGGERGSIRGEPLVKRSTSDPGHFGMASFVPAFHMGHHNGFFGPASIGGFLKDPSSAGPSGPAVAGFEPYAQCKE

SEQ ID NO: 277 - DNA, 1098 bp, Triticum aestivum
gcacgagcaagtgcgagtgcgactacctgcattgcaccttggctagccctagacatggagaacgacggcgtccccaacggaccagcggcgccggcacctacccaggggacgccggtggtgcgggagcaggaccggctgatgccgatcgcgaacgtgatccgcatcatgcgccgtgcgctccctgcccacgccaagatctccgacgacgccaaggaggcgattcaggaatgcgtgtccgagttcatcagcttcgtcaccggcgaggccaacgaacggtgccgcatgcagcaccgcaagaccgtcaacgccgaagacatcgtgtgggccctaaaccgcctcggcttcgacgactacgtcgtgcccctcagcgtcttcctgcaccgcatgcgcgaccccgaggcggggacaggtggtgccgctgcaggcgacagccgcgccgtgacgagtgcgcctccccgcgcggccccgcccgtgatccacgccgtgccgctgcaggctcagcgcccgatgtacgcgcccccggctccgttgcaggttgagaatcagatgcagcggcctgtgtacgctcccccggctccggtgcaggttcagatgcagcggggcatctatgggccccgggctccagtgcacgggtacgccgtcggaatggcgcccgtgcgggccaacgtcggcgggcagtaccaggtgttcggcggagagggtgtcatggcccagcaatactacgggtacgggtacgaggaaggagcgtacggcgcaggtagcagcaacggaggagccgccattggcgacgaggagagctcgtccaacggcgtgccggcaccgggggagggcatgggggagccagagccagagccagcagcagaagaatcgcatgacaagcccgtccaatctggctagtcgcgtgcgcggcgcgcgttagcttctgcgtcctgtgtactgtaataatttgccgtgtcgatccggccatggtttgtgtgtgcgtagtgcttatctaatgtgggcttgtcctctagtaattcatgtattgcttatctaatgtggacttgtcctctagtaattcatgtactctttgctgttgaaaaaaaaaaaaaaaaaaaa

SEQ ID NO: 278 - protein, 280 aa, Triticum aestivum
MENDGVPNGPAAPAPTQGTPVVREQDRLMPIANVIRIMRRALPAHAKISDDAKEAIQECVSEFISFVTGEANERCRMQHRKTVNAEDIVWALNRLGFDDYVVPLSVFLHRMRDPEAGTGGAAAGDSRAVTSAPPRAAPPVIHAVPLQAQRPMYAPPAPLQVENQMQRPVYAPPAPVQVQMQRGIYGPRAPVHGYAVGMAPVRANVGGQYQVFGGEGVMAQQYYGYGYEEGAYGAGSSNGGAAIGDEESSSNGVPAPGEGMGEPEPEPAAEESHDKPVQSG

SEQ ID NO: 279 - DNA, 932 bp, Canna edulis
gcaccagctcaaatctccgaattagggtttctgtgccttgtctccaatggcggaatcgggggccccgggcacgcccgagagcggacattccggcggcggatctggcgcgcgggagcaggaccgctgcctccccattgccaacattgggcggattatgaggaaggccgtacccgagaacggcaagatcgccaaggacgccaaggaatccgtccaggagtgcgtctccgagttcatcagcttcgtcaccagcgaggcgagcgataagtgccgccgcgagaaaaggaagacgatcaacggcgatgatcttctgtgggctatgcggatgcttggcttcgaagagtacgtcgagcctcttaagctctacttgcagctctacagagagatggagggaaacgtcatggtttcacgtcccgctgatcaatgatcaaccaggaaaaagagatggagcaattaacaggcagcccacagattcgttcaatggcatgtaggatggttctcaagaaagcaaacttttgcttactatttcaaggtgtaggccctttgttagtgtagttaataagttatagttgctgcaggttatttttgttcttatttgtactcttgtccaataccttttcctctaagtgaacaacattcagagaatggctcttctctaggacttggacgaaggcacgaagcactgatctgaagttatgatccattcaaccatctaaaattaattttaaattttaaattgagacaatgttttgacccttgtttcgacatttcccgacagccctactgtaatgtaaagatgacttggatagcaaaattgttaaaaaggtacaattcctgcaatgttttacaagtcaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 280 - protein, 121 aa, Canna edulis
MAESGAPGTPESGHSGGGSGAREQDRCLPIANIGRIMRKAVPENGKIAKDAKESVQECVSEFISFVTSEASDKCRREKRKTINGDDLLWAMRMLGFEEYVEPLKLYLQLYREMEGNVMVSR

SEQ ID NO: 281 - DNA, 863 bp, Momordica charantia
gcacgagcaggatctcgctcacatggcggaggctccgacgagtccagccggcggcagccacgagagcggcggcgagcagagccccaataccggtggggttcgggagcaggaccgatacctcccgatcgctaacattagccggatcatgaagaaggccttgcccgctaatggcaagatcgccaaggacgccaaggacaccgtccaggaatgcgtctccgaattcatcagcttcatcactagcgaggcgagcgataagtgccagaaggagaagagaaagaccattaatggggatgatttgctgtgggcaatggcgacattgggtttcgaggactatattgatccgcttaagtcgtatctaactaggtacagagagttggagtgtgatgctaagggatcttctaggggtggtgatgagtctgctaaaagagatgcagttggggccttgcctggccaaaattcccagcagtacatgcagccgggagcaatgacctacattaacacccaaggacagcatttgatcattccttcaatgcagaataatgaataggagactcctgcattccctcttggattgtctgaaatctgaggctggtagaagcgttcaacacctatatagcatctttacaatcgatttggctaatttattatgaaatgatgatattatatatatttctggggtttctgtgttggttctggatttgattttggtttgggcttttaaggtgggcttcgattttattgatgctctcgtcatctaaagttattgtaaatttgggaccttcaatttagtatagttgctttggtaatttggaaactggaaaaaaaaaaaaaaaaaaaaaaaaaaaaaaaaaaaaaaaaaaaaa

SEQ ID NO: 282 - protein, 174 aa, Momordica charantia
MAEAPTSPAGGSHESGGEQSPNTGGVREQDRYLPIANISRIMKKALPANGKIAKDAKDTVQECVSEFISFITSEASDKCQKEKRKTINGDDLLWAMATLGFEDYIDPLKSYLTRYRELECDAKGSSRGGDESAKRDAVGALPGQNSQQYMQPGAMTYINTQGQHLIIPSMQNNE

SEQ ID NO: 283 - DNA, 1179 bp, Eucalyptus grandis
gcaccagtttccccccgcccccccgatcgccgcccctcccgccggggccggcggcggcggggcgtcggcggcggcggcggaggatgtggggagctttctcacggaggatgaggtttcttctcttctatgtttttttttttgcagctgctcggcttgcctgccctctcgggcgacgacgcgatggcggaggctccggcgagtcccggcggcggcggcagccacgagagcggcgagcacagcccccggtccggcggcgccgtccgcgagcaggacaggtacctccccatcgccaacatcagccgcatcatgaagaaggccctccccgccaacggcaagatcgccaaggacgccaaggagaccgtgcaggagtgcgtctccgagttcatcagcttcatcaccagcgaggcgagcgacaagtgccagagggagaagaggaagacgatcaacggcgacgacttgctctggcccatggcgaccttagggtttgaggattacctcgatccgcttaagatttacctggccagatacagggagatggagggggataccaaggggtcagctaaagtgggggaagcatctactaaaagagatggcgccgcagttcagtcagttcctaatgcacagattgctcatcaaggttctttctctcacggcaccaactattcgcattctcaagttcaccatcctgcgcttccgatgcatggctcagaatgacatgttccagcccttgttgcatgagatgaagaagtcatcacacttgttccaggcgtttgactcatctcggcatcaagatattcataagatgtgctgctgacattttagggtggtctctgccaattgtgttcatttggagttgttttccagtgggctgtatattttagcatctgcatcatatttgctttcagccttacatatgtctggtttagatttacttgataatgtagaaaggtaagcccccctgcgagtatttatcttattgtcatttagattcgacacccaaggaggacgagaatgaagtttctttttagctctctgtttcgttggagttgtcttgtgtattcttgagttagaaacttgtgaacaaattggtatgcacagtccatgtttatgtgacaatgtcgaggtctgagtgtataatccagagtccaattcagatcgtaaaaaaaaaaaaaaaaaaaa

SEQ ID NO: 284 - protein, 177 aa, Eucalyptus grandis
MAEAPASPGGGGSHESGEHSPRSGGAVREQDRYLPIANISRIMKKALPANGKIAKDAKETVQECVSEFISFITSEASDKCQREKRKTINGDDLLWPMATLGFEDYLDPLKIYLARYREMEGDTKGSAKVGEASTKRDGAAVQSVPNAQIAHQGSFSHGTNYSHSQVHHPALPMHGSE

SEQ ID NO: 285 - DNA, 983 bp, Zea mays
gcacgagccggagcgcctcctcttctccagcgtccgatccccattccccacctctcctccctccgccgccagctcccgcccccttctctcccctcctcgcctccccgcgcgcgcgtttttataagggtttcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacagtaccacaatggggaaacctaataaagggctaatacagcagcaatttatgctagggaagtctctgcattgcttaccatgtgtattggcagaaaacaggaggcacttacaaagggtgttaatctctgcgatggctgcctctcaggtgtaaattggcttcggtttagcgctgcttttgtccgtatatttaggatgatttgactgttgctacttttggcaaccttttacatttacagatatgtattattcagcataaatataatatagtagtcctaggcctaaataatggtgattaacataccaagtcttttatcaggctactcgttttctggaacaaaaaaaaaaaaaaaaaaaaaa

SEQ ID NO: 286 - protein, 164 aa, Zea mays
MADDGGSHEGSGGGGGVREQDRFLPIANISRIMKKAVPANGKIAKDAKETLQECVSEFISFVTSEASDKCQKEKRKTINGDDLLWAMATLGFEEYVEPLKIYLQKYKEMEGDSKLSTKAGEGSVKKDAISPHGGTSSSSNQLVQHGVYNQGMGYMQPQYHNGET

SEQ ID NO: 287 - DNA, 1021 bp, Zea mays
ggcacgagcgctcctgttcttctcgcatccccagcccaggtggtgtcccctgtcgcgttgatgcatgctccctcggcggtggccttgagctgaggcggcggagcgatgccggactcggacaacgactccggcgggccgagcaacgccgggggcgagctgtcgtcgccgcgggagcaggaccggttcctgcccatcgccaacgtgagccggatcatgaagaaggcgctcccggccaacgccaagatcagcaaggacgccaaggagacggtgcaggagtgcgtgtccgagttcatctccttcatcaccggcgaggcctccgacaagtgccagcgcgagaagcgcaagaccatcaacggcgacgacctgctgtgggccatgaccacgctcggcttcgaggactacgtcgagccgctcaagcactacctgcacaagttccgcgagatcgagggcgagagggccgccgcgtccgccggcgcctcgggctcgcagcagcagcagcagcagggcgagctgcccagaggcgccgccaatgccgccgggtacgccgggtacggcgcgcctggctccggcggcatgatgatgatgatgatggggcagcccatgtacggcggctcgcagccgcagcaacagccgccgccgcctcagccgccacagcagcagcagcaacatcaacagcatcacatggcaataggaggcagaggaggattcggccaacaaggcggcggcggcggctcctcgtcgtcgtcagggcttggccggcaagacagggcgtgagttgcgacgatacgttcagaatcagaatcgctgatactcctacgtagaattatacctcctacctaattgatgacaccgcaccgcacctcgttgtgctgcctgtccttgtacgtttactaattactgctgcctgtatgtaaatcaaaatctgaggctcccatttcgaaacggacggtgaactactcttcccgtttcgtttcatacgagaatcgaactcgttttcaattaaaaaaaaaaaaaaaaaaaa

SEQ ID NO: 288 - protein, 222 aa, Zea mays
MPDSDNDSGGPSNAGGELSSPREQDRFLPIANVSRIMKKALPANAKISKDAKETVQECVSEFISFITGEASDKCQREKRKTINGDDLLWAMTTLGFEDYVEPLKHYLHKFREIEGERAAASAGASGSQQQQQQGELPRGAANAAGYAGYGAPGSGGMMMMMMGQPMYGGSQPQQQPPPPQPPQQQQQHQQHHMAIGGRGGFGQQGGGGGSSSSSGLGRQDRA

SEQ ID NO: 289 - DNA, 1055 bp, Oryza sativa
gcacgagcttacatctctctctctcctctcttctcttcttcctcccagactagtcagtctctcccaagaacacccactcctctagtctctctctcgagagagagaaaattgatgattcttgggatgattttgaggcgtctgatttgctgaagaggaggaggaggatgccggactcggacaacgactccggcgggccgagcaactacgcgggaggggagctgtcgtcgccgcgggagcaggacaggttcctgccgatcgcgaacgtgagcaggatcatgaagaaggcgctgccggcgaacgccaagatcagcaaggacgccaaggagacggtgcaggagtgcgtctccgagttcatctccttcatcaccggcgaggcctccgacaagtgccagcgcgagaagcgcaagaccatcaacggcgacgacctgctctgggccatgaccaccctcggcttcgaggactacgtcgaccccctcaagcactacctccacaagttccgcgagatcgagggcgagcgcgccgccgcctccaccaccggcgccggcaccagcgccgcctccaccacgccgccgcagcagcagcacaccgccaatgccgccggcggctacgccgggtacgccgccccgggagccggccccggcggcatgatgatgatgatggggcagcccatgtacggctcgccgccaccgccgccacagcagcagcagcagcaacaccaccacatggcaatgggaggaagaggcggcttcggtcatcatcccggcggcggcggcggcgggtcgtcgtcgtcgtcggggcacggtcggcaaaacaggggcgcttgacatcgctccgagacgagtagcatgcaccatggtacatatatacagtaatcagcagctgttcatttttctatgattactagttgacttaagcttgcaaatttgctaatctgagctcctgagtttttttttttggtcagcaatttcaagatggtcagaagctaaatttgtctatttgttactgataaattatttgttctctcaaaaaaaaaaaaaaaaaaaaaaaaaaaaaaa

SEQ ID NO: 290 - protein, 219 aa, Oryza sativa
MPDSDNDSGGPSNYAGGELSSPREQDRFLPIANVSRIMKKALPANAKISKDAKETVQECVSEFISFITGEASDKCQREKRKTINGDDLLWAMTTLGFEDYVDPLKHYLHKFREIEGERAAASTTGAGTSAASTTPPQQQHTANAAGGYAGYAAPGAGPGGMMMMMGQPMYGSPPPPPQQQQQQHHHMAMGGRGGFGHHPGGGGGGSSSSSGHGRQNRGA

SEQ ID NO: 291 - DNA, 873 bp, Oryza sativa
gtttttggagggcggcgcggggatggcggacgcggggcacgacgagagcgggagcccgccgaggagcggcggggtgagggagcaggacaggttcctgcccatcgccaacatcagccgcatcatgaagaaggccgtcccggcgaacggcaagatcgccaaggacgccaaggagaccctgcaggagtgcgtctcggagttcatctccttcgtcaccagcgaggcgagcgacaaatgtcagaaggagaagcgcaagaccatcaacggggaagatctcctctttgcgatgggtacgcttggctttgaggagtacgttgatccgttgaagatctatttacacaagtacagagagatggagggtgatagtaagctgtcctcaaaggctggtgatggttcagtaaagaaggatacaattggtccgcacagtggcgctagtagctcaagtgcgcaagggatggttggggcttacacccaagggatgggttatatgcaacctcagtatcataatggggacacctaaagatgaggacagtgaaaattttcagtaactggtgtcctctgtgagttattatccatctgttaaggaagaacccacattagggccatatttattagtagaagactaaagcacttgaagggtgttggtttagaaagggtgttaacagttggctgtggcgattgcttcacagatgtaaattgcttcataagtggtttaatgcttgtttttgcctgtatattcagagcaattttcacatattggtagttctgcaatcttttgcattcccatacatgtatcaggtggcacaaatctattgcaagtaccctagcattgaataatgctggttaacatataaaaaaaaaaaaaaaaaaaaaaaa

SEQ ID NO: 292 - protein, 164 aa, Oryza sativa
MADAGHDESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREMEGDSKLSSKAGDGSVKKDTIGPHSGASSSSAQGMVGAYTQGMGYMQPQYHNGDT

SEQ ID NO: 293 - DNA, 799 bp, Glycine max
gcacgagacgaaagcaacggtgaagatgaataatgagtgaggcaatccaatggtgagaaaggagtccgtgaaagcagagacttatcgagaaacaacggcacagaaggttccacgtgggaagcagataaaggaatattaagcagagagatccaacggacactgctagtgaaggcagaagaagaagattcctggattgattgtgaagatggctgagtcggacaacgactcgggaggggcgcagaacgcgggaaacagtggaaacttgagcgagttgtcgcctcgggaacaggaccggtttctccccatagcgaacgtgagcaggatcatgaagaaggccttgccggcgaacgcgaagatctcgaaggacgcgaaggagacggtgcaggaatgcgtgtcggagttcatcagcttcataacgggtgaggcgtcggacaagtgccagagggagaagcgcaagaccatcaacggcgacgatcttctctgggccatgacaaccctgggattcgaagagtacgtggagcctctgaagatttacctccagcgcttccgcgagatggagggagagaagaccgtggccgcccgcgactcttctaaggactcggcctccgcctcctcctatcatcagggacacgtgtacggctcccctgcctaccatcatcaagtgcctgggcccacttatcctgcccctggtagacccagatgacgtgctcctctattcgccactccctagactttttatattatattatttaattaaactctcttctccactcaacctttgcaaaaaaaaaaaaaaaaa

SEQ ID NO: 294 - protein, 165 aa, Glycine max
MAESDNDSGGAQNAGNSGNLSELSPREQDRFLPIANVSRIMKKALPANAKISKDAKETVQECVSEFISFITGEASDKCQREKRKTINGDDLLWAMTTLGFEEYVEPLKIYLQRFREMEGEKTVAARDSSKDSASASSYHQGHVYGSPAYHHQVPGPTYPAPGRPR

SEQ ID NO: 295 - DNA, 644 bp, Glycine max
gcacgagcagtttctggggcatctcaaaatcaatggaagatattggaggcagttcctcaaacgacaacaacaacaatggtggcatcatcaaggaacaggaccggttgctgccaatagccaatgttggtcggctcatgaagcggattcttcctcagaacgccaaaatctcgaaggaggcgaaggagacgatgcaggaatgtgtgtcggagttcataagcttcgtgacgagtgaggcttcggagaagtgcaggaaggagaggaggaagacagtgaatggtgatgacatttgttgggccttggcaacactaggctttgataactatgctgaaccaatgagaaggtacttgcatagatatagagaggttgaggtagatcataataaggtcaatcttcaagaaaaagggaatagtcctgaagagaaagacgatgaattatttaaattgagcaatagaggggttgggctttgaccaattattatgcttatagtagacaggaactcgttaatccattcatactcatcactgattactgattagatgaattagtaattttaaggtttttgtgaggatgagataatatatgtaataattttcttgtcttaattggaatttatcgagcttagaacaaaaaaaaaaaaaaaaaaa

SEQ ID NO: 296 - protein, 152 aa, Glycine max
SFWGISKSMEDIGGSSSNDNNNNGGIIKEQDRLLPIANVGRLMKRILPQNAKISKEAKETMQECVSEFISFVTSEASEKCRKERRKTVNGDDICWALATLGFDNYAEPMRRYLHRYREVEVDHNKVNLQEKGNSPEEKDDELFKLSNRGVGL

SEQ ID NO: 297 - DNA, 879 bp, Glycine max
gcacgagaaggaacgtgaaagtaaaacggacggtggcgatagaagcgtctctcatctccatcgtctcctcactcctctcttctccagcgttcattttttctcgcgcccaaatacaaaatcacatcacaacagggttccggcgaccatgtccgatgctccggcgagtccatgcggcggcggcggcggaggcagccacgagagcggcgagcacagtccccgctccaatttccgcgagcaggaccgcttcctccccatcgccaacatcagccgcatcatgaagaaagcgcttcctcccaacgggaaaatcgccaaggacgccaaggaaaccgtgcaggaatgcgtctccgagttcatcagcttcgtcaccagcgaagcgagcgataagtgtcagagagagaagaggaagaccatcaacggcgacgatttgctttgggctatgaccactttaggtttcgaggagtatattgatccgctcaaggtttacctcgccgcttacagagagattgagggtgattcaaagggttcggccaagggtggagatgcatctgctaagagagatgtttatcagagtcctaatggccaggttgctcatcaaggttctttctcacaaggtgttaattatacgaattcttagccccaggctcaacatatgatagttccgatgcaaggccaagagtagatattgatcctctccttcagtgtttgacatgtgtgatctaaatgccagtggaacttttatgtcaatatgtgcccttggtataatgaatgcattttatgttatgtaaacactacatgcggggatgttggttcttgtgaccagatattatttattaagacttacatttatctttggaaaaaaaaaaaaaaaaaaaaaaaaaa

SEQ ID NO: 298 - protein, 162 aa, Glycine max
MSDAPASPCGGGGGGSHESGEHSPRSNFREQDRFLPIANISRIMKKALPPNGKIAKDAKETVQECVSEFISFVTSEASDKCQREKRKTINGDDLLWAMTTLGFEEYIDPLKVYLAAYREIEGDSKGSAKGGDASAKRDVYQSPNGQVAHQGSFSQGVNYTNS

SEQ ID NO: 299 - DNA, 771 bp, Glycine max
gcacgagagtctttagaaaagatatccatggctgagtccgacaacgagtcaggaggtcacacggggaacgcgagcgggagcaacgagttgtccggttgcagggagcaagacaggttcctcccaatagcaaacgtgagcaggatcatgaagaaggcgttgccggcgaacgcgaagatatcgaaggaggcgaaggagacggtgcaggagtgcgtgtcggagttcatcagcttcataacaggagaggcttccgataagtgccagaaggagaagaggaagacgatcaacggcgacgatcttctctgggccatgactaccctgggcttcgaggactacgtggatcctctcaagatttacctgcacaagtatagggagatggagggggagaaaaccgctatgatgggaaggccacatgagagggatgagggttatggccatggccatggtcatgcaactcctatgatgacgatgatgatggggcatcagccccagcaccagcaccagcaccagcaccagcaccagcaccagggacacgtgtatggatctggatcagcatcttctgcaagaactagatagcatgtgtcatctgtttaagcttaattgattttattatgaggatgatatgatataagatttatattcgtatatgtttggttttagaaatacaccagctccagcttgtaattgcttgaaacttccttgttgagagaatatagacattattgtggatggtgatgtggcaaaaaaaaaaaaaaaaaaaaaaaaaaaaaaaaa

SEQ ID NO: 300 - protein, 181 aa, Glycine max
MAESDNESGGHTGNASGSNELSGCREQDRFLPIANVSRIMKKALPANAKISKEAKETVQECVSEFISFITGEASDKCQKEKRKTINGDDLLWAMTTLGFEDYVDPLKIYLHKYREMEGEKTAMMGRPHERDEGYGHGHGHATPMMTMMMGHQPQHQHQHQHQHQHQGHVYGSGSASSARTR

SEQ ID NO: 301 - DNA, 848 bp, Glycine max
gcgccaaatacaaattcgtgtcaacccaacccagggttccggcgagcatggccgacggtccggctagcccaggcggcggcagccacgagagcggcgaccacagccctcgctctaacgtgcgcgagcaggacaggtacctccctatcgctaacataagccgcatcatgaagaaggcacttcctgccaacggtaaaatcgcaaaggacgccaaagagaccgttcaggaatgcgtctccgagttcatcagcttcatcaccagcgagttatgtcagagagaaaagagaaagactattaacggcgatgatttgctctgggcgatggccactctcggtttcgaggattatatggatcctcttaaaatttacctcactagataccgagagatggagggtgatacgaagggctctgccaagggtggagactcatctgctaagagagatgttcagccaagtcctaatgctcagcttgctcatcaaggttctttctcacaaaatgttacttacccgaattctcagggtcgacatatgatggttccaatgcaaggcccggagtaggtatcaagtttattattgaccctcttgttgtaacgtatgttttctacgccagttaccaagtgctcacggcatattgaatgtctttttatgttatgtgaatactgacaggagatgttggttcttgtgtccgtttttttttttttaaattaaggtttgtatattatctttggattcgaattattatttgaaagttattattatattgtaaatcctagagccctgttgtctgaatccatcaggcggcttggtaaagaccgagattttaggactgattgtaagcataaatccgaatat

SEQ ID NO: 302 - protein, 168 aa, Glycine max
MADGPASPGGGSHESGDHSPRSNVREQDRYLPIANISRIMKKALPANGKIAKDAKETVQECVSEFISFITSELCQREKRKTINGDDLLWAMATLGFEDYMDPLKIYLTRYREMEGDTKGSAKGGDSSAKRDVQPSPNAQLAHQGSFSQNVTYPNSQGRHMMVPMQGPE

SEQ ID NO: 303 - DNA, 1097 bp, Triticum aestivum
gcacgaggcgccgccttctcttctccagcgtcggatcttcccccactcgccgccctcaccgcacctccattcccctccaccaccttccctccctccacgcgctcctctatataagggggagggccggatgtcggacgaggcggcgagccccccgggcggcggcggcggcggaggaggcggcggcagcgacgacggcggcggcggcggcggcttcggcggcgtcagggagcaggacaggttcctgcccatcgccaacatcagccgcatcatgaagaaggccatcccggccaacggcaagatcgccaaggacgccaaggagaccgtgcaggagtgcgtctccgagttcatctccttcatcaccagcgaggcgagcgacaagtgccagagggagaagcgcaagaccatcaacggcgacgacctgctctgggcgatggccacgctgggcttcgaggagtacatcgagcccctcaaggtttatctgcagaagtacagagagacggagggtgatagtaagctagctgggaagtctggtgatgtctctgttaaaaaggatgcactgggtcctcatggaggagcaagtggcacaagtgcgcaagggatgggccaacaagtagcatacaatccaggaatggtttatatgcaacctcagtaccataatggggacatctcaaactgaagatatggaccatctccgagactgctgctactctgctaggcgggttttcgtcatgtggagagcactaagcagttaaagaaaactcttagtacccccattagtctcgtgttgttgggtctgccagaactgatgctcaaaggctgcttcccagatgtaaattgctttttcctgagaatagattcagttgtggtttagcatggttgttgttgttgtctgtatatttatgatgattagcctcgtcgtggctgtcattcggttccatataatctgggtatttgggggagacataactcctccaggtgtagtttgtcctgaactagctgtatcagactcttgagaagagttgctattagccctccaaaaaaaaaaaaaaaaaaaaaaaaaaaaaaaaaaaaaaaaaaaaaaaaaaaaaaaaaaaaaa

SEQ ID NO: 304 - protein, 182 aa, Triticum aestivum
MSDEAASPPGGGGGGGGGGSDDGGGGGGFGGVREQDRFLPIANISRIMKKAIPANGKIAKDAKETVQECVSEFISFITSEASDKCQREKRKTINGDDLLWAMATLGFEEYIEPLKVYLQKYRETEGDSKLAGKSGDVSVKKDALGPHGGASGTSAQGMGQQVAYNPGMVYMQPQYHNGDISN

SEQ ID NO: 305 - DNA, 1016 bp, Triticum aestivum
ctcgtgccgcaaagattgaattttcgtacaagtgtccttccttccagttaacttcatgctcctgcttgatcaggctagagtggtttgattgcttcttgatttgagacacagatcggggagaggagccatgccggagtcggacaacgactccggcgggccgagcaacaccggcggggagggggagctgtcgtcgccgcgggagcaggaccgcttcctgcccatcgccaacgtgagccgcatcatgaagaaggcgctcccggccaacgccaagatcagcaaggacgccaaggagacggtgcaggagtgcgtctccgagttcatctccttcatcaccggcgaggcctccgacaagtgccagcgcgagaagcgcaagaccatcaacggcgacgacctcctctgggccatgaccaccctcggcttcgaggactacgtcgaccccctcaagcactacctccacaagttccgcgagatcgagggcgagagggccgccgccacgtcgacgtcaaccgcgccgcagcacctgcccgacaataatgccaccggttacgccgactatggtggcgccgctgtccccgccccggccccgggaggcatgatgatgatggggcagcccatgtacggctcaccgccgccgcagcagcagcaccaacatcaggttgcaatgggagggagagcgggctttccctatcacggaggcagcagcggtggcggcgggtcgtcttcttcgtcggggttcggacggaaagaggggtgacatcttttcttttcttttcgttttgagctgaccaaagtgagtgatttcaacatatgttcctctcttggatgaagccgtgacttgtagcttagggaaatccattcagtacaaggaggaataattgttcagcaaatcagttttcttctataaacaggaggaatgtataactacgagtctacaaatcatacctgggaagctctccatgaattacttgtttaacaacatggcgagacacaataccaatatattgatgttaaaaaaa

SEQ ID NO: 306 - protein, 208 aa, Triticum aestivum
MPESDNDSGGPSNTGGEGELSSPREQDRFLPIANVSRIMKKALPANAKISKDAKETVQECVSEFISFITGEASDKCQREKRKTINGDDLLWAMTTLGFEDYVDPLKHYLHKFREIEGERAAATSTSTAPQHLPDNNATGYADYGGAAVPAPAPGGMMMMGQPMYGSPPPQQQHQHQVAMGGRAGFPYHGGSSGGGGSSSSSGFGRKEG

SEQ ID NO: 307 - DNA, 982 bp, Triticum aestivum
gcacgaggcattccccacccctcctcgcagcgccaaccaccgtctcctcctcccccctcccttctctcccctccgctcctccccccccgcgcgcgcgttttttataagggtttcggggcgcgggatggccgacgacgacagcgggagcccccggggcggcggcggggtcagggagcaggaccgcttcctccccatcgccaacatcagccgcatcatgaagaaggccgtgccggccaacggcaagatcgccaaggacgccaaggagaccctccaggagtgcgtctccgagttcatctccttcgtcaccagcgaggccagcgacaagtgccagaaggagaagcgcaagaccatcaacggggacgatctgctctgggccatggccacgctcggattcgaggagtacgtagaccccctcaagatctacctgcaaaagtacagagatatggagggtgatagtaaattgacctcaaaatctggtgaaggatccgtgaagaaagatataattggtgctcatagtggtgcgactagctcaaacgcccaagcgatggttcagcatggagcttacgcccaagggatgggttatatgcaaccccagtaccataatggggacacctgaaactgaagatcaggcaattttcggcaatgggtattgctccatgagtggttatctatctgttaaggaagccgccccaacattaggttcatgatgatcattggctggaaactaaagcacctggaagggtgcttaacagttggttgtgatggctgcctccaagatgtaaattgcttccgagagaatagattcacctattatggtttagtgcttgtttttatctgtacattcagaataattcagccgttggtagtttggcaatcttttgtttcagatatttgtattaggaagcataaatatattacaactgggtattaacttataaaaaaaaaaaaaaaaaaaaaaaaaaaaaaaaaaaaaaaaaaaaaa

SEQ ID NO: 308 - protein, 163 aa, Triticum aestivum
MADDDSGSPRGGGGVREQDRFLPIANISRIMKKAVPANGKIAKDAKETLQECVSEFISFVTSEASDKCQKEKRKTINGDDLLWAMATLGFEEYVDPLKIYLQKYRDMEGDSKLTSKSGEGSVKKDIIGAHSGATSSNAQAMVQHGAYAQGMGYMQPQYHNGDT

SEQ ID NO: 309 - DNA, 622 bp, Momordica charantia
  unsure (529)..(530): n = A, C, G, or T
  unsure (532): n = A, C, G, or T
  unsure (565)..(566)..(567): n = A, C, G, or T
  unsure (569): n = A, C, G, or T
  unsure (599)..(600): n = A, C, G, or T
gcacgaggccaaagccttctaaaaatgtctcccactgtacaatccaatccaactccgacgccattttattccgccattgcaccacctctaatcctcgtctccgccttctaatttgccgattctcaattcctcctcctccgccggcggccgccatgagaaggtctccctctgtttctacttcctcctcctcctcctcctcctgcgtcggcggcggcggcttcgacagcaataatctcaatctcgccgcccctccgcgccggccgcaatcggagaagaccggagcgaaacgccggaagcggaatcaggacgacgccaaatgcgagattgagaatcgtaacggtaataacaacaacagcagcaacaacaatgcctcttccggccgccggagctccatttacagaggagtcactaggcaccgatggaccggccggttcgaagcgcatctctgggacaagagttcgtggaatagcattcagaacaaaaaaggaaggcaagtttatttgggagcatacgataacgaggaagctgnngnccgaacttatgacctcgctgccctcaagtaccnnngntcccggaaccaccctcaatttcccggtagnntcgtacaggaatgaaatagaag

SEQ ID NO: 310 - protein, 137 aa, Momordica charantia
  UNSURE (126)..(127): Xaa = any amino acid
MRRSPSVSTSSSSSSSCVGGGGFDSNNLNLAAPPRRPQSEKTGAKRRKRNQDDAKCEIENRNGNNNNSSNNNASSGRRSSIYRGVTRHRWTGRFEAHLWDKSSWNSIQNKKGRQVYLGAYDNEEAXXRTYDLAALKY

SEQ ID NO: 311 - DNA, 860 bp, Ricinus communis
  unsure (814)..(815)..(816): n = A, C, G, or T
gcacgagggttaccaaaaaaaacccacctctcttacattcttcaaagtcgcaaaatctttaccaaaagagagagagagagagacctaacttaaaaaaatcatactcttcttgagtactgcatttaagtttcttttgttttgtttctctcattaaaacaagaagaagaacttaagaagaagaagtaaatgaagaggtctcctacttccccgtgctcttcttcttcatcatcttcatattcatcttcttcagcttcatcttcttgtgtcggtcctgatgatactcctgtcgctcctggtagtcatcatcatcatgatcaccaccaattacgatcgcagaaatcatccaaacgcattagaaaagttaaaaaaaagcagcagaaccataatattgatcagaataatactaacaccactattactgctcctacctctgccagaagaagctccatttacagaggagtcacccggcatagatggacgggaaggtttgaggcacacctttgggataagagttcatggaataacattcaaaacaagaagggaagacaagtttatttgggggcctatgataatgaagaagcagctgctcatacttatgaccttgctgcccttaagtactggggaccagagacaaccttgaatttccccatagaaacatatcctaaagagcttgaagagatgcaaaagatgagcaaggaagagtacttggcatctcttcgacgccaaagcagtgggttttccagaggagtttctaagtaccgtggggttgctaggcatcaccacaatggtcgatgggaggcacgaatcggacgannntttggcaacaagtatctctaccttggcacttataacacacaaga

SEQ ID NO: 312 - protein, 224 aa, Ricinus communis
  UNSURE (210): Xaa = any amino acid
MKRSPTSPCSSSSSSSYSSSSASSSCVGPDDTPVAPGSHHHHDHHQLRSQKSSKRIRKVKKKQQNHNIDQNNTNTTITAPTSARRSSIYRGVTRHRWTGRFEAHLWDKSSWNNIQNKKGRQVYLGAYDNEEAAAHTYDLAALKYWGPETTLNFPIETYPKELEEMQKMSKEEYLASLRRQSSGFSRGVSKYRGVARHHHNGRWEARIGRXFGNKYLYLGTYNTQ

SEQ ID NO: 313 - DNA, 645 bp, Impatiens balsamia
  unsure (264): n = A, C, G, or T
  unsure (278): n = A, C, G, or T
  unsure (294): n = A, C, G, or T
  unsure (392): n = A, C, G, or T
  unsure (395): n = A, C, G, or T
  unsure (415): n = A, C, G, or T
  unsure (457): n = A, C, G, or T
  unsure (494)..(495): n = A, C, G, or T
  unsure (515): n = A, C, G, or T
  unsure (526): n = A, C, G, or T
  unsure (545): n = A, C, G, or T
  unsure (552): n = A, C, G, or T
  unsure (554): n = A, C, G, or T
  unsure (599): n = A, C, G, or T
  unsure (624): n = A, C, G, or T
  unsure (628): n = A, C, G, or T
  unsure (641): n = A, C, G, or T
catccatttacagaggcgttacgcgccatagatggactgggagatatgaagctcatctatgggataacagctgtaggagagaaggccaggccagaaaagggcgtcaagtgtacctaggtggatatgataaggaggataaggccgcaagagcttatgatttggctgctctcaaatattggggcctactgccactaccaactttccagtccgccgatttatggcaaaagaactccgaagaaatgaaacatgccactaaagcaaganttaccgcgtcattngaggagaaagagtagntggttcctccaaggggagcatcctattttataggggtgtgacaagcatcaccaacaggcccgatgggcaggcaagatttgtccaatttctggaaacangtnctgtacctggggacattttngactgaggaagaacagcaaagcatagacatttcggcgataantcaagaggtatgacccattacgattatgagatgaccnnatgagttggaccaccatganacgtctccatnggtggacacaaccgtgaanccgctgnanagtgcagaacatctcactcacacacacacacacaacacatcaagnttcctcgtagcaaatcctgaggcancccntcaaaccctacanccaa

SEQ ID NO: 314 - protein, 95 aa, Impatiens balsamia
  UNSURE (88): Xaa = any amino acid
  UNSURE (92): Xaa = any amino acid
SIYRGVTRHRWTGRYEAHLWDNSCRREGQARKGRQVYLGGYDKEDKAARAYDLAALKYWGLLPLPTFQSADLWQKNSEEMKHATKARXTASXEEK

SEQ ID NO: 315 - DNA, 1163 bp, Zea mays
gctagggtttgcgaaatcgtgacgcgagcacttgaagattcgcgaaagacagcgcgaccgacccacggcgatggccaccgtccaccctcaatccccggcgggtcccacccatctcccgcaggaggagcgacacggggacgccccggtaccgcccgccgtctccggcgaacccgccgccgcagcggaggcgggcggcgagatcgccgcgctcgacaagcagctcgccgtcgtcggcggcggcgaggagaggaggccggccggggccggggccggggccgccagcgcaggcgggggagggaagctggtggcggaggccatgcgcaagtacgctgccccgcggtcgtcgcgcttccacggcgtcaccaggctcaagtggagcggcaagtacgaggcgcacctttgggacaacaccagccaggtcgaaggccgcaagcgcaagggcaagcacgtgtacttaggcagctatgtcgatgaagagcaggctgcaaaggcacatgatttggctgcccttaaatattggggcacagggccaaacaccaaactgaacttcaatatttctgattatgagaaagaaattgaggttatgaagaccatgtcccaagatgaatttgtggcctacataaggagacaaagcagttgtttctcaagaggtacttcatcataccggggtgtaaccagacggaaggatggtaaatggcaagcaagaattggtaggatcggtgagagtagagacaccaaagacatttaccttgggacctttgaaactgaagaagaggcagcagaagcttatgacattgcagcgatcgagcttcggggtgttcatgcagtcaccaactttgacattagtaattactgtgaagatggtttgagaaaattagaaggcccatcagaggtggctaagcttggaagtccgtcggaggttgtgaagctcgctgggcaatagatactagattagcaacgtgtaaattagtttctatttcgtttcttttgtcttcatattctcccccttttgtattcctgattttttttgccgttttgtgagttccctccttgccttattggcaagccagtatttacccgactcgaaaggacaatgtgatgttgtattttagcctcaaaaaaaaaaaaaaaaaaaaaaaaaaaaaaaaaaaacaaaaaaaagg

SEQ ID NO: 316 - protein, 290 aa, Zea mays
MATVHPQSPAGPTHLPQEERHGDAPVPPAVSGEPAAAAEAGGEIAALDKQLAVVGGGEERRPAGAGAGAASAGGGGKLVAEAMRKYAAPRSSRFHGVTRLKWSGKYEAHLWDNTSQVEGRKRKGKHVYLGSYVDEEQAAKAHDLAALKYWGTGPNTKLNFNISDYEKEIEVMKTMSQDEFVAYIRRQSSCFSRGTSSYRGVTRRKDGKWQARIGRIGESRDTKDIYLGTFETEEEAAEAYDIAAIELRGVHAVTNFDISNYCEDGLRKLEGPSEVAKLGSPSEVVKLAGQ

SEQ ID NO: 317 - DNA, 1228 bp, Zea mays
gcacgagctgcactccatccactccaccgctagggactagaactagggtttgcgaaatcgtgacgcgagcacttgaagattcgcgaaagacagcgcgaccgacccacggcgatggccaccgtccaccctcaatccccggcgggccccacccatctcccgcaggaggagcgacacggggacgccccggtaccgcccgccgtctccggcgaacccgccgccgcagcggaggcgggcggcgagatcgccgcgctcgacaagcagctcgccgtcgtcggcggcggcgaggagaggaggccggccggggccggggccgccagcgcaggcgggggagggaagctggtggcggaggccatgcgcaagtacgctgccccgcggtcgtcgcgcttccacggcgtcaccaggctcaagtggagcggcaagtacgaggcgcacctttgggacaacaccagccaggtcgaaggccgcaagcgcaagggcaagcacgtgtacttaggcagctatgtcgatgaagagcaggctgcaaaggcacatgatttggctgcccttaaatattggggcacagggccaaacaccaaactgaacttcaatatttctgattatgagaaagaaattgaggttatgaagaccatgtcccaagatgaatttgtggcctacataaggagacaaagcagttgtttctcaagaggcacttcatcataccggggtgtaaccagacggaaggatggtaaatggcaagcaagaattggtaggattggtgagagtagagacaccaaagacatttaccttgggacctttgaaactgaagaagaggcagcagaagcttatgacatcgcagcgatcgagcttcggggtgttcatgcagtcaccaactttgacattagtaattactgtgaagatggtttgagaaaattagaaggcccatcagaggtggctaagcttggaagttcgtcggaggttgtgaagctcgctgggcaatagatactagattagcaacgtgtaaattagtttctatttcgtttcttttgtcttcatattctctcccttttgtattcctggttttttttgccgttttgtgatttcctccttgccttattggcaagccagtatttacccgattcgaaaggacaatgtgatgttgtattttagcctcaaaaaaaaaaaaaaaaaaaaaaaaaaaaaaaaaaaaaaaaaaaaaaaaaaaaaaaaaaaaaaaaaaaaaaaaaaaaaa

SEQ ID NO: 318 - protein, 288 aa, Zea mays
MATVHPQSPAGPTHLPQEERHGDAPVPPAVSGEPAAAAEAGGEIAALDKQLAVVGGGEERRPAGAGAASAGGGGKLVAEAMRKYAAPRSSRFHGVTRLKWSGKYEAHLWDNTSQVEGRKRKGKHVYLGSYVDEEQAAKAHDLAALKYWGTGPNTKLNFNISDYEKEIEVMKTMSQDEFVAYIRRQSSCFSRGTSSYRGVTRRKDGKWQARIGRIGESRDTKDIYLGTFETEEEAAEAYDIAAIELRGVHAVTNFDISNYCEDGLRKLEGPSEVAKLGSSSEVVKLAGQ

SEQ ID NO: 319 - DNA, 1710 bp, Zea mays
gtgaggcgccacgcaacaacaatggcagttggcacagaggcgcaacgcaaaaaccccccaccgccaccgctctataaaaaccccgtcctcctcctcctcctcctcctcccccgcctcgccgccagtcagattcaccaccggctcccctgcacaaccgcgtccgcgctgcaccaccaccgttcatcgaggaggaggggggacggagaccacggacatggagagatctcaacggcagtctcctccgccaccgtcgccgtcctcctcctcgtcctccgtctccgcggacaccgtcctcgtccctcccggaaagaggcggagggcggcgacggccaaggccggcgccgagcctaataagaggatccgcaaggaccccgccgccgccgccgcggggaagaggagctccgtctacaggggagtcaccaggcacaggtggacgggcaggttcgaggcgcatctctgggacaagcactgcctcgccgcgctccacaacaagaagaaaggcaggcaagtctacctgggggcgtatgacagcgaggaggcagctgctcgtgcctatgacctcgcagctctcaagtactggggtcctgagactctgctcaacttccctgtggaggattactccagcgagatgccggagatggaggccgtgtcccgggaggagtacctggcctccctccgccgcaggagcagcggcttctccaggggcgtctccaagtacagaggcgtcgccaggcatcaccacaacgggaggtgggaggcacggattgggcgagtctttgggaacaagtacctctacttgggaacatttgacactcaagaagaggcagccaaggcctatgaccttgcggccattgaataccgtggcgtcaatgctgtaaccaacttcgacatcagctgctacctggaccacccgctgttcctggcacagctccaacaggagccacaggtggtgccggcactcaaccaagaacctcaacctgatcagagcgaaaccggaactacagagcaagagccggagtcaagcgaagccaagacaccggatggcagtgcagaacccgatgagaacgcggtgcctgacgacaccgcggagcccctcaccacagtcgacgacagcatcgaagagggcttgtggagcccttgcatggattacgagctagacaccatgtcgagaccaaactttggcagctcaatcaatctgagcgagtggttcgctgacgcagacttcgactgcaacatcggatgcctgttcgatgggtgttctgcggctgacgaaggaagcaaggatggtgtaggtctggcagatttcagtctgtttgaggcaggtgatgtccagctgaaggatgttctttcggatatggaagaggggatacaacctccagcgatgatcagtgtgtgcaactaattctggaacccgaggaggttttcgctttccaggtgtcctgtcttgggtaatccttgatctgtctaatgccacagtgccactgcaccagagcagctgagaactttcttgtagaaagcccatggcagtttggcgttagacaagtgtgtcgatgttctttaattctttgaatttgcccctaggctgcttggctaacgttaagggtttgtcattgtctcacttagcctagattcaactaatcacatcctgaatctgaagtggttgtgctaaaaaaaaaaaaaaaaaaaaaaaaaaaaaaaaaaaaaaaaaaa

SEQ ID NO: 320 - protein, 395 aa, Zea mays
MERSQRQSPPPPSPSSSSSSVSADTVLVPPGKRRRAATAKAGAEPNKRIRKDPAAAAAGKRSSVYRGVTRHRWTGRFEAHLWDKHCLAALHNKKKGRQVYLGAYDSEEAAARAYDLAALKYWGPETLLNFPVEDYSSEMPEMEAVSREEYLASLRRRSSGFSRGVSKYRGVARHHHNGRWEARIGRVFGNKYLYLGTFDTQEEAAKAYDLAAIEYRGVNAVTNFDISCYLDHPLFLAQLQQEPQVVPALNQEPQPDQSETGTTEQEPESSEAKTPDGSAEPDENAVPDDTAEPLTTVDDSIEEGLWSPCMDYELDTMSRPNFGSSINLSEWFADADFDCNIGCLFDGCSAADEGSKDGVGLADFSLFEAGDVQLKDVLSDMEEGIQPPAMISVCN

SEQ ID NO: 321 - DNA, 1495 bp, Zea mays
gcaccaggtcagagtcaccaggcacaggtggacgggcaggttcgaggcgcatctctgggacaagcactgcctcgccgcgctccacaacaagaagaaaggcaggcaagtctacctgggggcgtatgacagcgaggaggcagctgctcgtgcctatgacctcgcagctctcaagtactggggtcctgagactctgctcaacttccctgtggaggattactccagcgagatgccggagatggaggccgtgtcccgggaggagtacctggcctccctccgccgcaggagcagcggcttctccaggggcgtctccaagtacagaggcgtcgccaggcatcaccacaacgggaggtgggaggcacggattgggcgagtctttgggaacaagtacctctacttgggaacatttgacactcaagaagaggcagccaaggcctatgaccttgcggccattgaataccgtggcgtcaatgctgtaaccaacttcgacatcagctgctacctggaccacccgctgttcctggcacagctccaacaggagccacaggtggtgccggcactcaaccaagaacctcaacctgatcagagcgaaaccggaactacagagcaagagccggagtcaagcgaagccaagacaccggatggcagtgcagaacccgatgagaacgcggtgcctgacgacaccgcggagcccctcaccacagtcgacgacagcatcgaagagggcttgtggagcccttgcatggattacgagctagacaccatgtcgagaccaaactttggcagctcaatcaatctgagcgagtggttcgctgacgcagacttcgactgcaacatcggatgcctgttcgatgggtgttctgcggctgacgaaggaagcaaggatggtgtaggtctggcagatttcagtctgtttgaggcaggtgatgtccagctgaaggatgttctttcggatatggaagaggggatacaacctccagcgatgatcagtgtgtgcaactaattctggaacccgaggaggttttcgctttccaggtgtcctgtcttgggtaatccttgatctgtctaatgccacagtgccactgcaccagagcagctgagaaccttcttgtagaaagcccatggcagtttggcgttagacaagtgtgtcgatgttctttaattctttgaatttgcccctaggctgcttggctaacgttaagggtttgtcattgtctcacttagcctagattcaactaatcacatcctgaatctgaagtggttgtgcttgtgcagtttatcactgagtttacatggcatgatcatggtaacgcagccagtgcagcatagatttgttcgtttgaacagtttaccaaggctgtaaccctagtaagctccagattaaggaacctttgttttcaccattctatatttactagatgaatgcccgtatgttgcaacgggaatatataatattagtatactacaataacttatatacaaaaaaaaaaaaaaaaaa

SEQ ID NO: 322 - protein, 332 aa, Zea mays
HQVRVTRHRWTGRFEAHLWDKHCLAALHNKKKGRQVYLGAYDSEEAAARAYDLAALKYWGPETLLNFPVEDYSSEMPEMEAVSREEYLASLRRRSSGFSRGVSKYRGVARHHHNGRWEARIGRVFGNKYLYLGTFDTQEEAAKAYDLAAIEYRGVNAVTNFDISCYLDHPLFLAQLQQEPQVVPALNQEPQPDQSETGTTEQEPESSEAKTPDGSAEPDENAVPDDTAEPLTTVDDSIEEGLWSPCMDYELDTMSRPNFGSSINLSEWFADADFDCNIGCLFDGCSAADEGSKDGVGLADFSLFEAGDVQLKDVLSDMEEGIQPPAMISVCN

SEQ ID NO: 323 - DNA, 1570 bp, Zea mays
ccacgcgtccggccgctgctcaccccgtcctagacgcgaggcgacgacgcctccctatccctctcctccgcaatggccaggccccgcaagaacggcggtaccgacgaggatgatgctaacgccgccacgggagccaccgggaagccgaagaagctgatgaagcgggcgcggaggaagagcgagagcccctccccgcgcagctccgcgtaccgcggcgtcacacggcaccggtggacggggcggttcgaggcgcacctgtgggacaaggacgcccgcaacggctcccggagcaagaaaggcaagcaagtttatctcggcgcgtacgacgacgaggacgcggcggcgcgcgcgcacgacctggcggcgctcaagtactggggccccgccggcaccgtcctcaacttcccgctgagcggctacgacgaggagcggagggagatggaggggcagccccgggaggagtacgtcgcgtcgctgcggcggcggagcagcggcttcgcgcgaggggtgtccaagtacaggggcgttgccaggcatcatcacaacgggagatgggaggcgaggatcgggcgcgtgttaggcaacaagtacctctatctcggcacttacgcaacacaagaggaggcggcagtggcgtatgacatggcggctatagaacaccgcggcttcaacgcggtcaccaacttcgacatcagccattacatcaaccactggcatcgacattgccatggcccctgcgacggcagcctcggcgcgatggacgtcgcaccgaacgtctcgctcgaactagacctactcgagtgcccggccaccgtcggcctcggcctcgaggagaccacgggcgacgatgaattccacaaccgcgaggactacctggggcaccttttcggcgtgcagcagcttcccgacgagatggggccgccggctcatcagatggcaccagcatcgtcggcgctcgatctggtgttgcagtcgcttaggttcaaggagctgatgcaacaggtttccgcggcgggagcctccgagaccaacggcggcagcatgcgtagctcgccatcaacgtccctgtgttcgttctcgccttcgcctctggagctgccatcgccgccgctacagcaacttactgaattcatcgatggcgcgccgccgcggtgcagcttcccggatgacgtgcagtcgttcttcgatttcaagaacgataacgacatgagcttcgtctacgcggaggttgacacattcctcttcggcgacctaggcgcatacgctccgccaatgttcgacttcgacctgtacgagtgatcaggatccgactgccagcgttccaagacgccagtgttgttaaaatggcttcataatttttgtttatgatgatgatgagatgactgctatcaaggtttacttgaaagaggtaggattagttatttattctcgcccttttttcaaatagctagaagaggaaaatatgcttctctttttttcttttttccctaaaaggctcaaaggtgtatacaagtcgtcacgaagaactaattgacattgatgacatctctactattataatgcaatagtt

SEQ ID NO: 324 - protein, 408 aa, Zea mays
MARPRKNGGTDEDDANAATGATGKPKKLMKRARRKSESPSPRSSAYRGVTRHRWTGRFEAHLWDKDARNGSRSKKGKQVYLGAYDDEDAAARAHDLAALKYWGPAGTVLNFPLSGYDEERREMEGQPREEYVASLRRRSSGFARGVSKYRGVARHHHNGRWEARIGRVLGNKYLYLGTYATQEEAAVAYDMAAIEHRGFNAVTNFDISHYINHWHRHCHGPCDGSLGAMDVAPNVSLELDLLECPATVGLGLEETTGDDEFHNREDYLGHLFGVQQLPDEMGPPAHQMAPASSALDLVLQSLRFKELMQQVSAAGASETNGGSMRSSPSTSLCSFSPSPLELPSPPLQQLTEFIDGAPPRCSFPDDVQSFFDFKNDNDMSFVYAEVDTFLFGDLGAYAPPMFDFDLYE

SEQ ID NO: 325 - DNA, 456 bp, Zea mays
gccatgtcgagatctaactttggcagctcgatcaacctgagcgagtggttcactgacgcagacttcgacagcgacttgggatgcctgttcgacgggcgctctgcagttgatggaggaagcaagggtggcgtaggtgtggcggatttcagtttgtttgaagcaggtgatggtcagctgaaggatgttctttcggatatggaagaggggatacaacctccaacgataatcagtgtgtgcaattgattctgagacctatgcgtggcgtgcgacaagtgtcctgtctttgggtatacttggtttgtccaatgccacggtgccactgctgcgagtcagctgaacttcttgtagaaagcacatggcagcttggcattagacaagtgtgttggtgttccttaattctttggatatgctttaggcattgactaaccttaagggttcgtcactgtctcgcttagc

SEQ ID NO: 326 - protein, 80 aa, Zea mays
AMSRSNFGSSINLSEWFTDADFDSDLGCLFDGRSAVDGGSKGGVGVADFSLFEAGDGQLKDVLSDMEEGIQPPTIISVCN

SEQ ID NO: 327 - DNA, 1879 bp, Zea mays
ctgctgagccgattagataaatccggcggaggaagagggaagaattatcgtgcgatatttcccccctcccactccctctctctctctctcgatttgcccgagaaatttttttggttgtttcccgcatcactctccactaggccgccgtctcccccgctggtgctcgtcgcttcctgcccaattcggcgccattcgcccggcgcactccctattaattccctgcctcggtagtcactggccgattgccacgtgaaatttcctgttccgttgcctttcgggtgcgcctgaagtacccacacgctactagggttcaatcgtcgtcagcaggcttacctctcaatcactgcggggcggcggctcgagagtttgtggacagttggcgaagagatagttaggttttttttttgtctcccgtgtccgatggaggaatcggacttgggaggtaatctgggtaagcaaacggaagaggataaggctgcgggagaatcaggggatgagggtaagatcgagaggagccaatctatcaatctgaatagagtgccagcagttgctgtagaggcgatgagcacccagggaaactgtgagacgcacggtgcagcagtgccaggaactaaggatgcaggcacaggaaaggcagggcaatccagtggcgatcgacaggaggagaagttacccaagtgtgagcaggtcgactatggaagtgaagttgaaggctgcgcagatgatgagaaccctggcaagagggctgctttagttactttggttggaaatgaatactgcggcgacgaggatgagagagttcaagtgctcaccattgtcaagaaggacgagcatgcagatgacattgtcgaccgtattaatcctggcacagttgcagggtacagtgaagtgaagggtgctgtaggtgcttctgccgccacttctgcggtgcgacctgctggctcccgatcgtcaagtttccatggtgtgactaggcatagatggagtgggaaatatgaagctcatttgtgggacagttcttgcagagtagagggacgtagaaggaaagggaaacaagtttatctaggaagttatgataccgaggaaaaagcggccagggcttatgatgttgctgctattaaatactggggcgaaaataccagactgaactttccgatttcacaatacggcaaggagttggaggacataagggatttgtctcgagaggaatgtgtgacatacttgagaaggaggagcagctgcttttcaagaggagcttctatttatagaggagtgacaagaaggcagaaagacgggagatggcaagcacgcataggactggttgctggaactagagacatttacctgggaacattcaaaacagaggaagaagctgcagaggcttatgatattgctgccattgagatacgtggcaaaaacgctgtgaccaattttgaccgaagcaactatgtcgataagggtatgcactgtatagaaggcgaaggcttgaggctgcttgcatccaagccagaagaatgacttccaagttcaatgcagtgattgtcgatcgagcagatttggccagacgtatatgcagcttagttggtacatatacagataggagaaccggttgcagtttgtcaatattcctgctttacatgacttgggattacagttaaatcgacccgctagcaaaaaaaagtgtgcaaatgttagtagatttggccagacatatatgaagattttggggttgtatcataaggcctcgtaggatagatctttctgcaaatgttagcgaagccagtgtttatgttctgtttgctagattagcgttatcagtttgcacgttccccttttttttctgaataattgtccttgtatgatcaaaaaaaaaaaaaaa

SEQ ID NO: 328 - protein, 365 aa, Zea mays
MEESDLGGNLGKQTEEDKAAGESGDEGKIERSQSINLNRVPAVAVEAMSTQGNCETHGAAVPGTKDAGTGKAGQSSGDRQEEKLPKCEQVDYGSEVEGCADDENPGKRAALVTLVGNEYCGDEDERVQVLTIVKKDEHADDIVDRINPGTVAGYSEVKGAVGASAATSAVRPAGSRSSSFHGVTRHRWSGKYEAHLWDSSCRVEGRRRKGKQVYLGSYDTEEKAARAYDVAAIKYWGENTRLNFPISQYGKELEDIRDLSREECVTYLRRRSSCFSRGASIYRGVTRRQKDGRWQARIGLVAGTRDIYLGTFKTEEEAAEAYDIAAIEIRGKNAVTNFDRSNYVDKGMHCIEGEGLRLLASKPEE

SEQ ID NO: 329 - DNA, 1683 bp, Zea mays
ccacgcgtccggcgctgcgcacaccgaacccctcgccgtcgcggctcgcctcggctccgccccgaccgaccgatcgatccggccggcggtgggcgccatggcctcccccaaccccgaggccgcggggctgcaggccgtggctgtggcgggggcaggggagggcggctcgtcctcgtcgctcagcgccgttgcgggagcggctgcgttgtccggggagctggtgcccaggagggcgttggcgctgcgcaaggagcgcgtgtgcacggccaaggagcgcatcagccgcatgcctccctgtgcggcggggaagcggagctccatctaccgcggggtcacccggcataggtggacaggtcgatatgaggctcacctttgggacaaaagcacgtggaatcagaatcagaacaaaaagggaaaacaggtatatctaggtgcatatgatgatgaagaggctgcagcaagggcctatgaccttgctgcattaaaatattggggagctggaacacaaataaatttcccagtatctgactatgcaagagaccttgaagagatgcagatgatatccaaggaggattatctcgtgtctcttaggagaaagagcagtgccttctacagggggttaccaaaatatcgtgggcttcttaggcaacttcataattccagatgggatacatctttgggactcggtaatgactacatgagccttagttgtggcaaggatatcatgttggatgggaaatttgcaggaagctttggtctagagaggaaaattgatcttacaaattacatccggtggtggctaccaaagaagacaaggcagtcagatacatctaaaacagaagaaattgctgatgaaattcgagctattgaaagttcaatgcaacagactgaaccctataagttgccttctcttggcttcagttctccatcaaagccctcttcaatgggcttatcagcatgcagcatattatctcagtctgatgcctttaaaagcttcttggagaagtctacaaaattatctgaagaatgtagtcttagcaaagaaattgttgaaggaaagactgttgcctcggtacctgctactggatatgatacaggggcaattaatattaacatgaatgagttgctagtacaaagatctacttactcaatgacccctgttatgcctacaccaacgaagagtacctggagccctgctgatccttccgtggatccacttttttggagcaactttgttttgccatcgagtcaacctgttacaatggcgacaataacaacaacaacaacgtttgcaaagaatgaggtaagttcaagtgatccattccagagccaagagtgactgcacgagcttattgaagcaggatattttagattggtcaaaggcagcatcccgtgcgtcaactagattctttttgtccagcttttgatgtcgcaacttgtgagcaatactccttgtttatccatacttcataggacatgaatagaaggtatgacaagtgcaagcatagttatgtaatatacagtggctagttgccagaaaatgagatttagttgtgtagagctgtttgtacatattgagatggttgtttcagttcaatctcaacaggtttgaggaaaatatccaacgaaatgatacagttttaatgctaaattagttattttgtacaaaaaaaaaaaaaaaag

SEQ ID NO: 330 - protein, 413 aa, Zea mays
MASPNPEAAGLQAVAVAGAGEGGSSSSLSAVAGAAALSGELVPRRALALRKERVCTAKERISRMPPCAAGKRSSIYRGVTRHRWTGRYEAHLWDKSTWNQNQNKKGKQVYLGAYDDEEAAARAYDLAALKYWGAGTQINFPVSDYARDLEEMQMISKEDYLVSLRRKSSAFYRGLPKYRGLLRQLHNSRWDTSLGLGNDYMSLSCGKDIMLDGKFAGSFGLERKIDLTNYIRWWLPKKTRQSDTSKTEEIADEIRAIESSMQQTEPYKLPSLGFSSPSKPSSMGLSACSILSQSDAFKSFLEKSTKLSEECSLSKEIVEGKTVASVPATGYDTGAININMNELLVQRSTYSMTPVMPTPTKSTWSPADPSVDPLFWSNFVLPSSQPVTMATITTTTTFAKNEVSSSDPFQSQE

SEQ ID NO: 331 - DNA, 1864 bp, Zea mays
gcacgagggtctacatcaacatcggtagctctcacattccctccaacggctgcactagcgccttcaattctatcgtatagcttcattcttcactggtgaacaaggcagtagctagcagatcgatctccatggacatggacatgagctcagcttatccccaccattggctctccttctccctctccaacaactaccaccatggcctactcgaggccttctctaactcctccggtactcctcttggagacgagccgggcgcagtggaggagtccccgaggacggtggaggacttcctcggcggcgtcggtggcgccggcgccccgccgcagccggcggctgctgcagatcaggatcaccagcttgtgtgcggcgagctgggcagcatcacagccaggttcttgcgccactacccggcggcgccagctgggacgacggtggagaaccccggcgcggtgaccgtggcggccatgtcgtcgacggacgtggcgggggcggagtccgaccaggcgaggcggcccgccgagacgttcggccagcgcacatccatctaccgtggcgtcaccaggcaccggtggacagggagatatgaggcgcacttgtgggacaacagctgccgccgggagggccaaagccgcaaaggacgccaagtctacctaggaggctatgacaaggaggagaaggcggctagagcttacgacctcgccgcgctcaagtactgggggcctacaaccacgaccaacttcccggtgtccaactacgagaaggagctggaggagatgaagtccatgacgcggcaagagttcatcgcgtcgttgcgcaggaagagcagcggcttctcacgaggcgcctccatctacagaggagtcacaaggcatcatcagcacggccggtggcaggcgaggatcggcagggtggccggaaacaaggacctgtacttgggcactttcagtactcaggaagaggcggcggaggcgtacgacatcgctgcgatcaagttccgcgggctcaacgccgtcaccaacttcgacatgagccgctacgacgtggagagcatcctcagcagcgacctccccgtcgggggcggagccaccgggcgcgccgccaagttcccgttggactcgctgcagccggggagcgctgctgcgatgatgctcgccggggctgctgccgcttcgcaggccaccatgccgccgtccgagaaggactactggtctctgctcgccctgcactaccagcagcagcaggagcaggagcggcagttcccggcttctgcttacgaggcttacggctccggcggcgtgaacgtggacttcacgatgggcaccagtagcggcaacaacaacaacaacaccggcagcggcgtcatgtggggcgccaccactggtgcagtagtagtgggacagcaagacagcagcggcaagcagggcaacggctatgccagcaacattccttatgctgctgctgctgctatggtttctggatctgctggctacgagggctccaccggcgacaatggaacctgggttactacgactattaccagcagcaacaccggcacggctccccactactacaactatctcttcgggatggagtaggtgcatgcgctgacaagctagctagctgaaatcaggtggtaggcctaggaagaagctaggactgacatggaactgatcacaattttggctgctacatataccatgcatgccccatgtatggatgggggtgcgtgtgcttccttctgcttgctattcacgacacttgctgacttactgtggcagagccgcagagggctcgtgtaccatcagcatttctaaattctaattatcaagctcgtttcaatctaaaaaaaaaaaaaaaaaaa

SEQ ID NO: 332 - protein, 489 aa, Zea mays
MDMDMSSAYPHHWLSFSLSNNYHHGLLEAFSNSSGTPLGDEPGAVEESPRTVEDFLGGVGGAGAPPQPAAAADQDHQLVCGELGSITARFLRHYPAAPAGTTVENPGAVTVAAMSSTDVAGAESDQARRPAETFGQRTSIYRGVTRHRWTGRYEAHLWDNSCRREGQSRKGRQVYLGGYDKEEKAARAYDLAALKYWGPTTTTNFPVSNYEKELEEMKSMTRQEFIASLRRKSSGFSRGASIYRGVTRHHQHGRWQARIGRVAGNKDLYLGTFSTQEEAAEAYDIAAIKFRGLNAVTNFDMSRYDVESILSSDLPVGGGATGRAAKFPLDSLQPGSAAAMMLAGAAAASQATMPPSEKDYWSLLALHYQQQQEQERQFPASAYEAYGSGGVNVDFTMGTSSGNNNNNTGSGVMWGATTGAVVVGQQDSSGKQGNGYASNIPYAAAAAMVSGSAGYEGSTGDNGTWVTTTITSSNTGTAPHYYNYLFGME

SEQ ID NO: 333 - DNA, 1753 bp, Zea mays
gcacgagggcagcagctagcagatcgatctccatggacatggacatgagctcagcttatccccaccattggctctccttctccctctccaacaactaccaccatggcctactcgaagccttctctaactcctccggtactcctcttggagacgagcagggcgcagtggaggagtccccgaggacggtggaggacttcctcggcggcgtcggttgcgtcggcgccccgccgcagccggcggctgcagatcaggatcaccagcttgtgtgcggcgagctgggcagcatcacagccaggttcttgcgccactacccggcggcgccagctgggacgacggtggagaaccccggcgcggtgaccgtggcggccatgtcgtcgacggacgtggcgggggcggagtccgaccaggcgaggcggcccgccgagacgttcgcccagcgcacatccatctaccgtggcgtcaccaggcaccggtggacggggagatatgaggcgcacctgtgggacaacagctgccgccgggagggccaaagccgcaaaggacgccaagtctacctaggaggctatgacaaggaggagaaggcggctagagcttacgacctcgccgcgctcaagtactgggggcctacaaccacgaccaacttccaggtgtccaactacgagaaggagctggaggagatgaaatccatgacgcggcaggagttcatcgcgtcgttgcgcaggaagagcagcggcttctcacgaggcgcctccatctacagaggagtcacaaggcatcatcagcacggccggtggcaggcgaggatcggcagggtggccggaaacaaggacctgtacttgggcactttcagtactcaggaagaggcggcggaggcgtacgacatcgctgcgatcaagttccgcgggctcaacgccgtcaccaactttgacatgagccgctacgacgtggagagcatcctcagcagcgacctccccgtcgggggcggagctagcggtcgcgcccccgccaagttcccgttggactcgctgcagccggggagcgctgccgccatgatgctcgccggggctgctgccgcttcgcaggccaccatgccgccgtccgagaaggactactggtctctgctcgccctgcactaccagcagcagcaggagcaggagcggcagttcccggcttctgcttacgaggcttacggctccggcggcgtgaacgtggacttcacgatgggcaccagcagcggcagcaacaacaacaccggcagcggcgtcatgtggggcgccacctctggtgcagtagtgggccagcaagacagcagcagcaagcagggcaacggctatgccagtaacattccttatgctgctgctatggtttctggaactgctggctacgagggctccaccggcgacaatggaacctgggttactacgactaccagcagcaacaccggcacggctccccactactacaactatctcttcgggatggagtaggtgcatgcgctgacaagctagctagctgaaatcaggtggtaggcctaggaagaagctaggactgacatggaactgatcacaattttggctgctacatataccatgcatgccccatgtatggatgggggtgcgtgtccgtccttctgcttgctattcacgacacttgctgacttactgtggcagagccgcagagggctcgtgtaccatcagcatttctaaattctaattatcaagctcgtttcaagctaaaaaaaaaaaaaaaaaaa

SEQ ID NO: 334 - protein, 484 aa, Zea mays
MDMDMSSAYPHHWLSFSLSNNYHHGLLEAFSNSSGTPLGDEQGAVEESPRTVEDFLGGVGCVGAPPQPAAADQDHQLVCGELGSITARFLRHYPAAPAGTTVENPGAVTVAAMSSTDVAGAESDQARRPAETFAQRTSIYRGVTRHRWTGRYEAHLWDNSCRREGQSRKGRQVYLGGYDKEEKAARAYDLAALKYWGPTTTTNFQVSNYEKELEEMKSMTRQEFIASLRRKSSGFSRGASIYRGVTRHHQHGRWQARIGRVAGNKDLYLGTFSTQEEAAEAYDIAAIKFRGLNAVTNFDMSRYDVESILSSDLPVGGGASGRAPAKFPLDSLQPGSAAAMMLAGAAAASQATMPPSEKDYWSLLALHYQQQQEQERQFPASAYEAYGSGGVNVDFTMGTSSGSNNNTGSGVMWGATSGAVVGQQDSSSKQGNGYASNIPYAAAMVSGTAGYEGSTGDNGTWVTTTTSSNTGTAPHYYNYLFGME

SEQ ID NO: 335 - DNA, 460 bp, Zea mays
  unsure (420): n = A, C, G, or T
  unsure (456): n = A, C, G, or T
gtgaggtcacaaccgccggatccttctcgctcttgggccagcctgcgcctgggcaggtttcgtgggaggtgacgactgccgtcgctgcggaccgcaacaccttctcgcgcgcacgcgaccctgcgccctcaccaccaccgtccccggcgctgccgctcgtgcaaaccacctcccagtcccagaggacctccatctaccgcgggggaccaaggcacaggtggacggggcggtacgaggcgcacctgtgggacaacacgtgcgtaaggaaggccaagaagcgcaaggggcgccaagtctatttgggtggctactacaaagaagataaggctgcaagggcatatgacattgccgctctgaagtattggggtgataatgctactactaacttccctagagagaactacatcaagagagatacangatatgcaagaacaatgaacaagcgtgatgttgtancatt

SEQ ID NO: 336 - protein, 151 aa, Zea mays
  UNSURE (140): Xaa = any amino acid
EVTTAGSFSLLGQPAPGQVSWEVTTAVAADRNTFSRARDPAPSPPPSPALPLVQTTSQSQRTSIYRGVTKHRWTGRYEAHLWDNTCRKEGQEAQGAQVYLGGYYKEDKAARAYDIAALKYWGDNATTNFPRENYIKRDTXYARTMNKRDVV

SEQ ID NO: 337 - DNA, 1758 bp, Oryza sativa
tctacatcgatcaatagctttatagttatccttccctctcataagctcaaacaaacgctggtcaagtgctcttcaagatcggcgcatcgatcatatctatcgccatggacatggacatgagctcggcttatcctcaccattggctctccttctccctctctaacaactaccaccatggcctccttgaggccctctctaccacatctgcacctccacttggagaggaggggccagcggagggcgctccgaagatggaggatttcctcggcggcctaggcggaggcggcggcgccgtcgccgccgctccggcagctgccccggaggatcagctcagctgcggcgagcttggtagcatcgccgccgggttcttgcgccggtacccagcgcctgagaacgccggcggggtgaccatcgcaatggcgaccgacgcggcggcggagctggccgatccggcgaggaggaccgccgagacgttcgggcaacggacgtccatctaccgtggtgtcactaggcaccggtggacggggaggtacgaggcgcacctgtgggacaatagctgccgccgggaaggccaaagccgcaaaggccgccaagtctacttaggaggttatgataaggaggagaaggccgcaagagcttacgacctcgccgccctaaagtactggggtccaaccaccacgacgaacttccctgttgccaactacgagacggagctggaggagatgaagtccatgacgcggcaggagttcatcgcgtcgctgcgcaggaagagcagcggcttctcaagaggggcttccatctacagaggagtaacaagacatcatcagcacggccggtggcaagcgaggatcggcagggtggccggaaacaaggacctgtacttgggcactttcagcacgcaggaggaggctgccgaggcgtacgacattgccgctatcaagttcagggggctcaacgccgtcaccaacttcgacatgagccgctacgacgtcgacagcatcctcaacagcgacctgccggtcggcggcggagccgccacgcgcgcctctaagttcccctctgacccatcgctgccgctgccgtcgcctgccatgccaccgtcggagaaggactactggtccctccttgccctgcactaccaccaccaccagcagcagcagcagcagcagcagtttcctgcttctgcatttgacacctacggctgctcctccggcgtgaacgtggacttcacaatggggactagcagccacagcggcagcaacagcaacagcagcagcagcagcgccatatggggcacagccgccggcgcagcgatggggaggcagcaaaacggcggcagcagcaacaagcagagcaacagctactccggtaacaacattccttatgctgctgcagcagctatgacttctggatcagcactctacgggggctccaccggtagcaacgggacatgggtggcgagtaacacgagcacggctccccacttctacaactatttgtttgggatggagtaggtggacttactggctctattagcttcattagctgaaacgagtggtaggcctaggactgacatggaactgatcaaaagttttggctgctgatgcatgcaggaatgcaatgcaatgcatccttaagattattcttttgcttccctgacatagtcctgtagcagagaaactcatgtatcaccagtgtttctaattcaagctcatttttttaaaaaaaaaaaaaaaaaaaaaaaaaaaaaaaaaaaaa

SEQ ID NO: 338 - protein, 469 aa, Oryza sativa
MDMDMSSAYPHHWLSFSLSNNYHHGLLEALSTTSAPPLGEEGPAEGAPKMEDFLGGLGGGGGAVAAAPAAAPEDQLSCGELGSIAAGFLRRYPAPENAGGVTIAMATDAAAELADPARRTAETFGQRTSIYRGVTRHRWTGRYEAHLWDNSCRREGQSRKGRQVYLGGYDKEEKAARAYDLAALKYWGPTTTTNFPVANYETELEEMKSMTRQEFIASLRRKSSGFSRGASIYRGVTRHHQHGRWQARIGRVAGNKDLYLGTFSTQEEAAEAYDIAAIKFRGLNAVTNFDMSRYDVDSILNSDLPVGGGAATRASKFPSDPSLPLPSPAMPPSEKDYWSLLALHYHHHQQQQQQQQFPASAFDTYGCSSGVNVDFTMGTSSHSGSNSNSSSSSAIWGTAAGAAMGRQQNGGSSNKQSNSYSGNNIPYAAAAAMTSGSALYGGSTGSNGTWVASNTSTAPHFYNYLFGME

SEQ ID NO: 339 - DNA, 1208 bp, Oryza sativa
gcacgaggcagcactcaagtactggggtccaacaactcacataaattttccattgagcacttatgagaaggagctggaggagatgaagcacatgacaaggcaggagttcattgcccacttaagaaggaacagcagtggcttctcgaggggagcatccatgtacagaggggtgacgaggcatcaccagcacgggagatggcaggcaaggattggaagggtcgcagggaacaaggacctgtatctcggcaccttcagcacgcaggaggaagcggcggaggcgtacgacatagcggcgatcaagttccgcggcctgaacgccgtgaccaacttcgacatcagcaagtacgacgtgaagcgcatctgctccagcacccacctcatcggcggcgacctcgcgtgccgccgctccccgacgcgcatgctaccaccggacgctccggccggcgccgccggcgtcgacgtcgtcgtggcgccgggcgaccaccagcagatcagcgccggtggcggcggcgcgtccgacaactcggacaccgcctccgacggccaccgcggcgcgcacatgctgcacggcctgcagtacgcgcacgccatgaagttcgaggccggcgagagcagcggcggcggcggcggagacggcgccaccaccaactggatggccgccgccgccgccgcggcgcgcccggtcgccggcatcccgaccaccgtgcaccaccagctcccggtgttcgcgctgtggaacgactgatttttaattccattcccgcgatctctgctagtacaatattttttttctactgtgccgcacgcgcgtcgtcgtcgcacgtagtagtacgtggttagcgccatactgccatgcgtggtactagtgcttttgtgcactagcggcgggagactgctacgcatgtgacgaccggacccgggggcgcgtgcggtgcgcgcatatatattgatgtgagcccaaagctgtgcagggcgtgatgcatgcgtgtctcacggttggcatcttctccccccgaaggtggcgacaattttgccgcattttgtaacggttttaacatgcatgctctatatatgcgctagctccaccggaagcatacgatttctccggatttttactgtattttatgatggcgaaactgagtagtactagtagtaaaatcttgtctcgatcatttcctccaaaaaaaaaaaaaaaaaaaaaaaaaaaa

SEQ ID NO: 340 - protein, 245 aa, Oryza sativa
AALKYWGPTTHINFPLSTYEKELEEMKHMTRQEFIAHLRRNSSGFSRGASMYRGVTRHHQHGRWQARIGRVAGNKDLYLGTFSTQEEAAEAYDIAAIKFRGLNAVTNFDISKYDVKRICSSTHLIGGDLACRRSPTRMLPPDAPAGAAGVDVVVAPGDHQQISAGGGGASDNSDTASDGHRGAHMLHGLQYAHAMKFEAGESSGGGGGDGATTNWMAAAAAAARPVAGIPTTVHHQLPVFALWND

SEQ ID NO: 341 - DNA, 551 bp, Oryza sativa
  unsure (493)..(494)..(495): n = A, C, G, or T
  unsure (541)..(542)..(543): n = A, C, G, or T
gcacgaggcagacaaggaagggaaggcaagtatatctaggtggttatgacactgaagataaagctgcgagggcttatgatctggctgcgctgaaatactgggggctatctacgcatataaatttcccgttagaaaactaccgagatgagatcgaggagatggaaaggatgacaaggcaagaatatgttgcgcacttgagaaggagaagcagcgggttctctcgcggtgcttccatctaccggggagtaacaaggcatcaccagcatggaagatggcaagctcggattggcagggttgctggcaacaaggacttgtatctcggcactttcagcactcaagaagaagcagcagaggcatacgacattgctgccatcaagttccgtggcctgaacgcggtgacgaactttgacatcacaaggtacgacgtggacaagatcatggagagcagctcgctgctgcctggtgaggcagcgcgtaaggtgaaggcgatcgnnncagcgccggaccatgtgccaataggccgcgagctcggtgcgaccgnnnaagcgagc

SEQ ID NO: 342 - protein, 160 aa, Oryza sativa
QTRKGRQVYLGGYDTEDKAARAYDLAALKYWGLSTHINFPLENYRDEIEEMERMTRQEYVAHLRRRSSGFSRGASIYRGVTRHHQHGRWQARIGRVAGNKDLYLGTFSTQEEAAEAYDIAAIKFRGLNAVTNFDITRYDVDKIMESSSLLPGEAARKVKA

SEQ ID NO: 343 - DNA, 1271 bp, Glycine max
tcgggccttcactcttgaactgtatgcgtgtgcagtgcagtggtcctctctctcgttgccagttttcatggcgaagaaatcacagaaaagcctcaacagcactgggaagcgcacacgcaaaagcgtcccaagagactcacctccacaacgaagttcaatctataggggtgtcacaaggcatcgatggactggtcgatatgaggctcatttgtgggataagaattgctggaatgaatcacagagcaagaaaggaagacaagtatatctaggggcatatgatgatgaagaagccgcagcacgtgcctatgacttggcagcattgaagtactggggccaagataccattctcaattttccattatcaaattatgaggaaaagctcaaggagatggagggccagtcaaaagaagaatatattggatccttgagaagaaaaagcagtggattctctcgaggagtttcaaaatacagaggcgtagcaagacaccaccataacggaagatgggaagctcgaattggaagggtctttggcaacaaatatctataccttggaacttacgctacacaagaagaagcagccgcagcatatgacatggcagcaatagaatacagaggacttaacgcggttacaaactttgacctgagccgttatatcaattggccacgtcctaaaacagaagaaaatcatcaaactattcctagcaatgaaaatgtaaactctaatgctgaacttgagctaggttcggctagtgatgagatcacagaagagggtgtagcaccatcttcagaatcaaatccttctcgtcgcacattccctgaagacattcaaacaatttttgaaaatcaagattcaggcatctacactgaaaatgatgatatcatttttggtgacctgggctcctttggtgcaccaatttttcattacgagcttgatgtttagaattggaggacttcttctggccaatacgttatttttcaaaagggggtaatcaaccaaaaaagatgataaagaaattagggggtaagagtaaacattttagagatcgagtggaagattctttaaaagtaacatacaaggggggaagagggattggatcattttatttgcgatagaacaagatgcatggcatacaagtacaactgcctcattttaacaatttagttttattatgtatgtctccacaagcgtgggtagatgtcacaacatttagttattataagcaataagaataatatttttttaaaaaaaaaaaaaaaaaaaaaaaaaaaaa

SEQ ID NO: 344 - protein, 312 aa, Glycine max
RAFTLELYACAVQWSSLSLPVFMAKKSQKSLNSTGKRTRKSVPRDSPPQRSSIYRGVTRHRWTGRYEAHLWDKNCWNESQSKKGRQVYLGAYDDEEAAARAYDLAALKYWGQDTILNFPLSNYEEKLKEMEGQSKEEYIGSLRRKSSGFSRGVSKYRGVARHHHNGRWEARIGRVFGNKYLYLGTYATQEEAAAAYDMAAIEYRGLNAVTNFDLSRYINWPRPKTEENHQTIPSNENVNSNAELELGSASDEITEEGVAPSSESNPSRRTFPEDIQTIFENQDSGIYTENDDIIFGDLGSFGAPIFHYELDV

SEQ ID NO: 345 - DNA, 494 bp, Glycine max
  unsure (44): n = A, C, G, or T
  unsure (94): n = A, C, G, or T
  unsure (188): n = A, C, G, or T
  unsure (249): n = A, C, G, or T
  unsure (317): n = A, C, G, or T
  unsure (327): n = A, C, G, or T
  unsure (333): n = A, C, G, or T
  unsure (341): n = A, C, G, or T
  unsure (344): n = A, C, G, or T
  unsure (352): n = A, C, G, or T
  unsure (363): n = A, C, G, or T
  unsure (378): n = A, C, G, or T
  unsure (385): n = A, C, G, or T
  unsure (387): n = A, C, G, or T
  unsure (399): n = A, C, G, or T
  unsure (409): n = A, C, G, or T
  unsure (431): n = A, C, G, or T
  unsure (433): n = A, C, G, or T
  unsure (442): n = A, C, G, or T
  unsure (449): n = A, C, G, or T
  unsure (453)..(454): n = A, C, G, or T
  unsure (460): n = A, C, G, or T
  unsure (471): n = A, C, G, or T
  unsure (478): n = A, C, G, or T
  unsure (481): n = A, C, G, or T
  unsure (485): n = A, C, G, or T
  unsure (491): n = A, C, G, or T
catcatcataatggtcgctgggaagcacgaattggaagagtatncggaaacaagtacctctacttggggacatataaaactcaagaggaggcancagtggcatatgacatggcagcaatagagtaccgtggagtcaatgcagtgaccaattttgacataagcaactacatggacaaaataaagaaganaaatgaccaaacccaacaacaacaaacagaagcacaaacggaaacagttcctaactcctcngactctgaagaagtagaagtagaacaacagacaacaacaataaccacaccacccccatctgaaatctncacatgccancacagnagcaccangtncgatacancccccatgtcntccaagggaagagantcatcanantgatcacaattntggacatgtnttagcagactgcatggacttangnaactggctngctagtnaagnncaactngctttgaaagngtgtgcntgnggangttgcngtg

SEQ ID NO: 346 - protein, 101 aa, Glycine max
HHHNGRWEARIGRVCGNKYLYLGTYKTQEEAAVAYDMAAIEYRGVNAVTNFDISNYMDKIKKKNDQTQQQQTEAQTETVPNSSDSEEVEVEQQTTTITTPP

SEQ ID NO: 347 - DNA, 1874 bp, Glycine max
gcttagttctccccttaaccaaaccaaaaccacttgatctattctttttcatttaatcgaaaaataatagtaactataatatcaccaccacaccgacatggagaagaagtagctgtccgttcaaagagactagttcttcattttgcaccatttcattcatatatctcaatggcccgtgctactaactggctttcgttctctctctccccaatggaaatgctccgaacctccgaacctcagttccttcaatacgacgccgcttccgctacttcctcacatcactactacctcgacaacttgtacaccaacgggtggggcaacgggagcctcaagtttgagcagaatctcaaccacagtgacgtgagttttgttgaatcttcgtcgcagagcgtcggccacgtgccgccgccgccgccgaagctggaggattttctcggcgactcctccgccgtgatgcgttactccgacagccagacggagacgcaggactcgtcgctgacgcacatctacgaccaccaccaccaccaccaccaccaccacggttctacttcgtacttcggtggtgaccagcaggatctcaaggccattactggatttcaagctttttcgaccaactccggttccgaggttgatgattctgcatccatcggaaaagcgcaggccagcgagttcgggactcactctattgagtcctccggcaacgagttcgccgcgttctccggtggcacaaccggaaccttgtcgctcgccgttgcactgagctccgagaaggccgttgtcgcggcggagtccaatagctcgaagaagatcgtggataccttcggccagcggacttctatttacagaggtgttactaggcaccgatggacaggaagatatgaagcgcatctatgggacaatagttgcagaagggagggtcaagccagaaaagggcgtcaagtttatttgggtggatatgataaggaagaaaaggccgcgagagcttatgatttggcagctctaaagtactggggtcccactgctaccaccaacttccctgtttccaattattcgaaggaagtggaggagatgaaacatgtaacaaagcaagaatttattgcatcattgcggaggaaaagtagtggtttctccaggggagcttccatatacagaggtgttacaaggcatcatcaacagggtaggtggcaagcaagaattggccgtgtagctggaaacaaagatttatacttgggaacattcgcaaccgaggaggaagcagcagaggcatatgatattgcagccataaagttcagaggtgcaaacgcggtaaccaactttgagatgaatagatatgatgtggaagctataatgaagagttctcttccagtgggtggggcagcaaaacgcttgaggctttcccttgaatcagagcagaaagctcctcctgtgaacagcagcagtcagcagcagaatccacagtgtggtaacgtgagtggtagcatcaatttctcagccattcatcagccaattgcttcaatcccttgtggaattccgtttgattcaacaacagcatattatcctcacaaccttttccaacattttcaccctaccaacgctggtgcagcagcgtctgctgttacttctgccaatgcaaccgcactaactgcactgccagcatcagcagcaactgagttctttatttggcctcatcagtcttattgatctaatcaaaactagaatcaaaatctttttctaatttcctggttatgctaacaaatcaaacgccatagtctctggcacagtttagctgacccccctcctctattattaacctaaactaaaaaaggaaaaaaaaaaaaaaaaaaaaaaaaaaaaaaaaaaaaaaaaaaaaaaaa

SEQ ID NO: 348 - protein, 510 aa, Glycine max
MARATNWLSFSLSPMEMLRTSEPQFLQYDAASATSSHHYYLDNLYTNGWGNGSLKFEQNLNHSDVSFVESSSQSVGHVPPPPPKLEDFLGDSSAVMRYSDSQTETQDSSLTHIYDHHHHHHHHHGSTSYFGGDQQDLKAITGFQAFSTNSGSEVDDSASIGKAQASEFGTHSIESSGNEFAAFSGGTTGTLSLAVALSSEKAVVAAESNSSKKIVDTFGQRTSIYRGVTRHRWTGRYEAHLWDNSCRREGQARKGRQVYLGGYDKEEKAARAYDLAALKYWGPTATTNFPVSNYSKEVEEMKHVTKQEFIASLRRKSSGFSRGASIYRGVTRHHQQGRWQARIGRVAGNKDLYLGTFATEEEAAEAYDIAAIKFRGANAVTNFEMNRYDVEAIMKSSLPVGGAAKRLRLSLESEQKAPPVNSSSQQQNPQCGNVSGSINFSAIHQPIASIPCGIPFDSTTAYYPHNLFQHFHPTNAGAAASAVTSANATALTALPASAATEFFIWPHQSY

SEQ ID NO: 349 - DNA, 1024 bp, Glycine max
gcacgagctctaaagtactggggaccaaaagcaaccactaactttcctatttccaattatacaaaggaattggaggagatgaagcatgtaggaaagcaagaatttattgcatcactgcgaaggaaaagcagtggtttttcgaggggagcttctgcttacaggggtgttacaaggcatcaccaacagggtagatggcaagcgagaattggccgggttgcgggaaacaaggatctatatttgggaacattttcaactgaagaggaggcagcagaggcatatgatattgcagccataaagttcagaggtgcaagtgccgtaaccaatttcgagatgaggcgatatgacgtcgacgctatattgaacaactctcttccagttggcggcatagcaaaacgctttaaagtttccccagaaacggagaacaaagctcttgtcagcaccattcaaccacctcagaacacaaacgccagtagcagcatcaatttctcaaccattcagccagtgtcttctataccctatgattctgcaatcacatgttacccccacaacctcttccaccattttaatcccaccaacggtgaaagtagcactgcagaatttgctgcaactatgaccgatgcaatcgcactcgctacccttccaccactggcagttcctgggttcttcgtatggcctcatcagaactattgaattgtggaaatgatcaactagctaattttctgttctgctaacaaatagaaagctagtttatggtgcaatttagcttgacctgcttctgggtctgacccctctttaacccttttgctgagaagaaagataggttttttgctcggaaagtccgagtcatagtaactgtagggaatggattatgtaagtaacttctctaagttgaggagtattgagttgtggtttttcaagcttgaacaaagcttttctaattttgcttgataacttactgcagcataataaatgcttacttttttcttctccaaaaaaaaaaaaaaaaaaaaaaaaaaaaaaaaaa

SEQ ID NO: 350 - protein, 229 aa, Glycine max
ARALKYWGPKATTNFPISNYTKELEEMKHVGKQEFIASLRRKSSGFSRGASAYRGVTRHHQQGRWQARIGRVAGNKDLYLGTFSTEEEAAEAYDIAAIKFRGASAVTNFEMRRYDVDAILNNSLPVGGIAKRFKVSPETENKALVSTIQPPQNTNASSSINFSTIQPVSSIPYDSAITCYPHNLFHHFNPTNGESSTAEFAATMTDAIALATLPPLAVPGFFVWPHQNY

SEQ ID NO: 351 - DNA, 2588 bp, Glycine max
gcacgagctgtgtaatattcttcaatatcatggggtctatgaatttgttaggtttttctctctctcctcacgaagaacacccttctagtcaagatcactctcaaacgacaccttctcgttttagcttcaaccctgatggatcaatctcaagcactgatgtagcaggaggctgctttgatctcacttctgactcaactcctcatttacttaaccttccttcttatggcatatacgaagcatttcacagaaacaatagtattaacaccactcaagattggaaggagaactacaacagccaaaatttgctattgggaacttcgtgcaataaacaaaacatgaaccaaaaccaacagcaacagccaaagcttgaaaacttcctcggtggacactcatttggcgaacatgagcaaacctacggtggtaactcagcctctacagattacatgtttcctgctcagccagtatcggctggtggtggtggtagtggtggtggcagtaacaataacaacaacagtaactccatagggttatccatgataaagacatggttgaggaaccaaccaccgaactcagaaaacatcaacaacaacaatgaaagtggtggcaatattagaagcagtgtgcagcaaactctatcactttccatgagtactggttcacaatcaagcacatcactgccccttctcactgctagtgtggataatggagagagttcttctgataacaaacaaccaaacacctcggctgcacttgattccacccaaaccggagccattgaaactgcacccagaaagtccattgacacttttggacagagaacttctatctaccgtggtgtaacaaggcataggtggacggggaggtacgaggctcacctgtgggataatagttgtagaagagagggacagactcgcaaaggaaggcaagtttacttgggtggttatgataaagaagaaaaggcagctagagcctacgatttggcagcactaaaatactggggaacaaccacaacaacaaattttccaattagccactatgagaaagagttggaagaaatgaagcacatgactaggcaagagtacgttgcgtcattgagaaggaagagtagtgggttttctcgcggtgcatccatttatcgaggagtgacgagacaccaccaacatggaaggtggcaagcgaggattggaagagttgctggcaacaaggatctttacttgggaacttttagcacccaagaagaggcagcggaagcatatgatgtagcagcaatcaaattccgaggactaagtgctgttacaaactttgacatgagcagatatgacgtgaaaagcatacttgagagcaccactttgccaataggtggtgctgcaaagcgtttgaaggatatggagcaggttgaactgagtgtggataatggtcatagagcagatcaagtagatcatagtatcatcatgagttctcacctaactcaaggaatcaataacaactatgcaggagggggaacagcaactcatcataactggcacaatgctcatgcattccaccaacctcaaccttgcaccaccatgcactacccttatggacaaagaattaattggtgcaagcaagaacaacaagacaactctgatgcccctcactctttgtcttattcagatattcatcaacttcagctagggaacaatggaacacataacttctttcacacaaattcagggttgcaccctatgttgagcatggattctgcttccattgacaatagctcttcttctaactcggttgtttatgatggttatggaggtggtgggggctacaatgtgatgcctatgggaactactactgctgttgttgcaagtgatggtgatcaaaatccaagaagcaatcatggttttggtgataatgagataaaagcacttggttatgaaagtgtgtatggctctgcaactgattcttatcatgcacatgcaaggaacttgtattatcttactcaacagcaatcatcttctgttgatacagtgaaggctagtgcatatgatcaagggtctgcatgcaatacttgggttccaactgctattccaactcatgcacccagatcaactactagtatggctctctgccatggggctactacacccttctctttattgcatgaataggtggaaaactagggagagaaggaagagtcaaaaaggtgatgaagaagatgcatatattgctgacttgtttcttcctcttgtgaagttgctaatttgatagtgtgcacttttgaagatgaggatatataggatttctttcactatctctaacttgcaggatccttatttcactagggtctaagtaatctagcctcaagtttagtcatggcagaagcatttgctgtgaattttgggaattaactttggagaatgtgtggacagatcattgggatgtttttattatcagcggactttttaattctggaataacaacgatcataccaagggtggagttttcctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 352 - protein, 707 aa, Glycine max
MGSMNLLGFSLSPHEEHPSSQDHSQTTPSRFSFNPDGSISSTDVAGGCFDLTSDSTPHLLNLPSYGIYEAFHRNNSINTTQDWKENYNSQNLLLGTSCNKQNMNQNQQQQPKLENFLGGHSFGEHEQTYGGNSASTDYMFPAQPVSAGGGGSGGGSNNNNNSNSIGLSMIKTWLRNQPPNSENINNNNESGGNIRSSVQQTLSLSMSTGSQSSTSLPLLTASVDNGESSSDNKQPNTSAALDSTQTGAIETAPRKSIDTFGQRTSIYRGVTRHRWTGRYEAHLWDNSCRREGQTRKGRQVYLGGYDKEEKAARAYDLAALKYWGTTTTTNFPISHYEKELEEMKHMTRQEYVASLRRKSSGFSRGASIYRGVTRHHQHGRWQARIGRVAGNKDLYLGTFSTQEEAAEAYDVAAIKFRGLSAVTNFDMSRYDVKSILESTTLPIGGAAKRLKDMEQVELSVDNGHRADQVDHSIIMSSHLTQGINNNYAGGGTATHHNWHNAHAFHQPQPCTTMHYPYGQRINWCKQEQQDNSDAPHSLSYSDIHQLQLGNNGTHNFFHTNSGLHPMLSMDSASIDNSSSSNSVVYDGYGGGGGYNVMPMGTTTAVVASDGDQNPRSNHGFGDNEIKALGYESVYGSATDSYHAHARNLYYLTQQQSSSVDTVKASAYDQGSACNTWVPTAIPTHAPRSTTSMALCHGATTPFSLLHE

SEQ ID NO: 353 - DNA, 1824 bp, Glycine max
gcacgagggataatggagagagttcttctgataacaaacaaccaaacacctcggctgcacttgattccacccaaaccggagccattgaaactgcacccagaaagtccattgacacttttggacagagaacttctatctaccgtggtgtaacaaggcataggtggacggggaggtacgaggctcacctgtgggataatagttgtagaagagagggacagactcgcaaaggaaggcaagtttacttgggtggttatgataaagaagaaaaggcagctagagcctacgatttggcagcactaaaatactggggaacaaccacaacaacaaattttccaattagccactatgagaaagagttggaagaaatgaagcacatgactaggcaagagtacgttgcgtcattgagaaggaagagtagtgggttttctcgcggtgcatccatttatcgaggagtgacgagacaccaccaacatggaaggtggcaagcgaggattggaagagttgctggcaacaaggatctttacttgggaacttttagcacccaagaagaggcagcggaagcatatgatgtagcagcaatcaaattccgaggactaagtgctgttacaaactttgacatgagcagatatgacgtgaaaagcatacttgagagcaccactttgccaataggtggtgctgcaaagcgtttgaaggatatggagcaggttgaactgagtgtggataatggtcatagagcagatcaagtagatcatagtatcatcatgagttctcacctaactcaaggaatcaataacaactatgcaggagggggaacagcaactcatcataactggcacaatgctcatgcattccaccaacctcaaccttgcaccaccatgcactacccttatggacaaagaattaattggtgcaagcaagaacaacaagacaactctgatgcccctcactctttgtcttattcagatattcatcaacttcagctagggaacaatggaacacataacttctttcacacaaattcagggttgcaccctatgttgagcatggattctgcttccattgacaatagctcttcttctaactcggttgtttatgatggttatggaggtggtgggggctacaatgtgatgcctatgggaactactactgctgttgttgcaagtgatggtgatcaaaatccaagaagcaatcatggttttggtgataatgagataaaagcacttggttatgaaagtgtgtatggctctgcaactgattcttatcatgcacatgcaaggaacttgtattatcttactcaacagcaatcatcttctgttgatacagtgaaggctagtgcatatgatcaagggtctgcatgcaatacttgggttccaactgctattccaactcatgcacccagatcaactactagtatggctctctgccatggggctactacacccttctctttattgcatgaataggtggaaaactagggagagaaggaagagtcaaaaaggtgatgaagaagatgcatatattgctgacttgtttcttcctcttgtgaagttgctaatttgatagtgtgcacttttgaagatgaggatatataggatttctttcactatctctaacttgcaggatccttatttcactagggtctaagtaatctagcctcaagtttagtcatggcagaagcatttgctgtgaattttgggaattaactttggagaatgtgtggacagatcattgggatgtttttattatcagcggactttttaattctggaataacaacgatcataccaagggtggagttttcctcaaaaaaaaaaaaaaaaaaaaa

SEQ ID NO: 354 - protein, 486 aa, Glycine max
TRDNGESSSDNKQPNTSAALDSTQTGAIETAPRKSIDTFGQRTSIYRGVTRHRWTGRYEAHLWDNSCRREGQTRKGRQVYLGGYDKEEKAARAYDLAALKYWGTTTTTNFPISHYEKELEEMKHMTRQEYVASLRRKSSGFSRGASIYRGVTRHHQHGRWQARIGRVAGNKDLYLGTFSTQEEAAEAYDVAAIKFRGLSAVTNFDMSRYDVKSILESTTLPIGGAAKRLKDMEQVELSVDNGHRADQVDHSIIMSSHLTQGINNNYAGGGTATHHNWHNAHAFHQPQPCTTMHYPYGQRINWCKQEQQDNSDAPHSLSYSDIHQLQLGNNGTHNFFHTNSGLHPMLSMDSASIDNSSSSNSVVYDGYGGGGGYNVMPMGTTTAVVASDGDQNPRSNHGFGDNEIKALGYESVYGSATDSYHAHARNLYYLTQQQSSSVDTVKASAYDQGSACNTWVPTAIPTHAPRSTTSMALCHGATTPFSLLHE

SEQ ID NO: 355 - DNA, 2463 bp, Glycine max
gcacgagccttctcctcctccttttctttcaaaccttctcttataaactagtagcacatgcttcttcttcttctccttcttcacgcacaaaccgctatatattttcacccttcatatatctatctacttctaaaggttagattaccttgagggctttgtgatctcttttgtgatagtcaatatcatggggtctatgaatttgttaggtttttctctctctcctcaagaacacccttctagtcaagatcactctcaaacggcaccttctcgtttttgcttcaaccctgatggaatctcaagcactgatgtagcaggagactgctttgatctcacttctgactcaactcctcatttactcaaccttccctcttacggcatatacgaagcttttcataggagcaacaatattcacaccactcaagattggaaggagaactacaacagccaaaacttgctattgggaacttcatgcagcaaccaaaacatgaaccacaaccatcagcaacaacaacaacaacagccaaagcttgaaaacttcctcggtggacactcatttggtgaacatgagcaaccctacggtggtaactcagcctctacagaatacatgttcccggctcagccggtattggccggtggcggcggcggtggtagcaatagcagcaacacaagcaacagtagctccatagggttatccatgataaagacatggttgaggaaccaaccaccacactcagaaaacaacaataacaacaacaatgaaagtggtggcaatagtagaagcagtgtgcagcagactctatcactttccatgagtactggttcacaatcaagcacatcactaccccttctcactgctagtgtggataatggagagagttcttctgataacaaacaaccacataccacggctgcacttgatacaacccaaaccggagccattgaaactgcacccagaaagtccattgacacttttggacagagaacttctatctaccgtggtgtaacaaggcataggtggacggggaggtatgaggctcacctgtgggataatagttgtagaagagagggacaaactcgcaaaggaaggcaagtttacttgggaggttatgacaaagaagaaaaggcagctagagcctacgatttggcagcactaaaatactggggaacaactacgacaacaaattttccaattagccactatgagaaagagttggaagaaatgaagcacatgactaggcaagagtacgttgcgtcattgagaaggaagagtagtgggttttctcgcggggcatccatttatcgaggtgtgacgagacaccatcaacatggaagatggcaagcgaggattggaagagttgctggcaacaaggatctctacttgggaactttcagcacccaagaggaggcagcagaagcatatgatgtagcagcaatcaaattcagaggactaagtgctgttacaaactttgacatgagcagatatgacgtgaaaagcatacttgagagcaccactttgccaattggtggtgctgcaaagcgtttgaaggatatggagcaggtggaactgagggtggagaatgttcatagagcagatcaagaagatcatagtagcatcatgaactctcacttaactcaaggaatcattaacaactatgcagcaggaggaacaacagcgactcatcatcataactggcacaatgctcttgcattccaccaacctcaaccttgcaccaccatacactacccttatggacaaagaattaattggtgcaagcaagaacaagacaactctgatgcctctcactctttgtcttattcagatattcatcaactacagctagggaacaatggcacacacaacttctttcacacaaattcagggttgcaccctatgttaagcatggattctgcttccattgacaatagctcttcatctaactctgttgtttatgatggttatggaggtggtgggggctataatgtgattcctatggggactactactactgttgttgcaaatgatggtgatcaaaatccaagaagcaatcatggttttggtgataatgagataaaggcacttggttatgaaagtgtgtatggttctacaactgatccttatcatgcacatgcaaggaacttgtattatcttactcaacagcaaccatcttctgttgatgcagtgaaggctagtgcatatgatcaaggatctgcatgcaatacttgggttccaactgctattccaactcatgcaccaaggtctagtactagtatggctctctgccatggtgctacgcccttctctttattgcatgaataggtggaaaaactagggaaaaggaagagtcaccaaggagattaaaatgatgcatatattgatgacttggttcttcctctttatgaatgaagttgctaatttgatagtgtgtgcacttttgaagatgagaaaaaaaaaaaaaaaaaaaa

SEQ ID NO: 356 - protein, 710 aa, Glycine max
MGSMNLLGFSLSPQEHPSSQDHSQTAPSRFCFNPDGISSTDVAGDCFDLTSDSTPHLLNLPSYGIYEAFHRSNNIHTTQDWKENYNSQNLLLGTSCSNQNMNHNHQQQQQQQPKLENFLGGHSFGEHEQPYGGNSASTEYMFPAQPVLAGGGGGGSNSSNTSNSSSIGLSMIKTWLRNQPPHSENNNNNNNESGGNSRSSVQQTLSLSMSTGSQSSTSLPLLTASVDNGESSSDNKQPHTTAALDTTQTGAIETAPRKSIDTFGQRTSIYRGVTRHRWTGRYEAHLWDNSCRREGQTRKGRQVYLGGYDKEEKAARAYDLAALKYWGTTTTTNFPISHYEKELEEMKHMTRQEYVASLRRKSSGFSRGASIYRGVTRHHQHGRWQARIGRVAGNKDLYLGTFSTQEEAAEAYDVAAIKFRGLSAVTNFDMSRYDVKSILESTTLPIGGAAKRLKDMEQVELRVENVHRADQEDHSSIMNSHLTQGIINNYAAGGTTATHHHNWHNALAFHQPQPCTTIHYPYGQRINWCKQEQDNSDASHSLSYSDIHQLQLGNNGTHNFFHTNSGLHPMLSMDSASIDNSSSSNSVVYDGYGGGGGYNVIPMGTTTTVVANDGDQNPRSNHGFGDNEIKALGYESVYGSTTDPYHAHARNLYYLTQQQPSSVDAVKASAYDQGSACNTWVPTAIPTHAPRSSTSMALCHGATPFSLLHE

SEQ ID NO: 357 - DNA, 2168 bp, Glycine max
ccacgcgtccgcagatagattctataagatcgcagtttccaaagaagctaactgaagttcaaacccccataacctctctttcacgttcctcaacgacacataaaacacacaccatggactcttcttcttcatcaccgccaaacagcaccaacaacaactccctcgctttctctctttccaatcactttcccaacccttcttcctctcccctttctctcttccactccttcacctatccatctctctctctcacaggcagcaacacggtggacgcaccgcctgagcccaccgctggagcaggaccgaccaacctctccatattcaccggcggccccaagttcgaggactttctgggcggttccgccgcaacagccaccaccgtcgcgtgtgcaccgccacagcttccgcagttctccaccgacaacaacaaccacctatacgattcggagctgaagtcaacaatagccgcgtgcttccctcgcgccttggccgccgaacaaagcaccgaaccgcaaaaaccatcccccaagaaaaccgtcgacaccttcgggcaacgcacctccatctaccgcggcgtgacccgacatagatggactgggagatacgaagctcatctatgggacaatagttgcagaagggaaggtcaaagcaggaaaggaaggcaagtttacttgggtggttatgacaaggaggataaggcagccagagcttatgatctcgcagctctcaagtactggggtccaactaccaccactaactttcctatttccaactatgagaaggaactggaggagatgaagaacatgactaggcaagagtttgttgcttctcttcgtaggaagagcagtggtttctctagaggggcctctatatacagaggagtaacgagacaccaccagcatggccgatggcaggcgagaataggcagagttgccggaaacaaagacctctaccttggcactttcagcacccaagaagaagctgctgaggcctatgacattgctgctatcaaattcaggggattaaatgcagtaacaaactttgacatgagtcgctacgacgtgaagagcattgcaaatagtactcttcctattggtggtttatctggcaagaacaagaactccacagattctgcatctgagagcaaaagccatgagccaagccaatccgatggagatccatcatcggcttcatcggtgacctttgcatcacagcaacaaccttcaagctccaacttaagctttgccatacccattaagcaagacccttcagattactggtccatcttggggtaccataatactccccttgacaacagtggcatcaggaacactactagtactgttactacaactacttttccatcctccaacaatggcactgctagtagtttgacacccttcaacatggagttctcaagtgccccctcaagtaccggcagcgataacaatgccgcgtttttcagtggaggaggcatctttgttcagcaacaaactagtcatggtcatggaaatgcaagcagtggttcctcctcttcttctttaagctgttcaatcccattcgccacgcccatattttctctaaatagcaatactagttatgagagcagtgctggttatggaaactggattggacctaccctgcacacattccaatcccatgcaaaaccaagtctctttcaaacgccaatatttggaatggaatgagctcatgcacgagctgggatgagaatctgtgcatataatgatgaaaggggaagaaggacaatagtggtgatggtgttttagcatgcaaagaagcaaaggacggactagtccctttagctgatgcagtatttgaatgagttggactgacagtcataatttcatgagaatcgtagctatacctagcagctgacactgtactaactcaaacttcctttgttatgttttgaatgaattttcctttttctttttcgcccctttattagctttttggtcctgttaatatactgacattatatcaaatgaggataatgggaagaaaaaaaaaatccttttgtaatccctttcatctcattttttgttagtatcaacttgccatctatgtgaaactaggcattcaatgcctatatatattgatgtacctttggtatgttttctcttaaaaaaaaaaaaaaaaaaaaaaag

SEQ ID NO: 358 - protein, 530 aa, Glycine max
MDSSSSSPPNSTNNNSLAFSLSNHFPNPSSSPLSLFHSFTYPSLSLTGSNTVDAPPEPTAGAGPTNLSIFTGGPKFEDFLGGSAATATTVACAPPQLPQFSTDNNNHLYDSELKSTIAACFPRALAAEQSTEPQKPSPKKTVDTFGQRTSIYRGVTRHRWTGRYEAHLWDNSCRREGQSRKGRQVYLGGYDKEDKAARAYDLAALKYWGPTTTTNFPISNYEKELEEMKNMTRQEFVASLRRKSSGFSRGASIYRGVTRHHQHGRWQARIGRVAGNKDLYLGTFSTQEEAAEAYDIAAIKFRGLNAVTNFDMSRYDVKSIANSTLPIGGLSGKNKNSTDSASESKSHEPSQSDGDPSSASSVTFASQQQPSSSNLSFAIPIKQDPSDYWSILGYHNTPLDNSGIRNTTSTVTTTTFPSSNNGTASSLTPFNMEFSSAPSSTGSDNNAAFFSGGGIFVQQQTSHGHGNASSGSSSSSLSCSIPFATPIFSLNSNTSYESSAGYGNWIGPTLHTFQSHAKPSLFQTPIFGME

SEQ ID NO: 359 - DNA, 1290 bp, Glycine max
gcacgagtttgtccctcactatgagccccagtgtgcaaaatggggtgggtgcaatttcctctgttcaagtgaatgaggatagtaggaaacgggtcatggcgaaatctcatgctagagaaccagttcctcgcaaatctattgacacttttgggcaaagaacatctcaatatcgtggtgttacaaggcatagatggactggaagatatgaggcccatttgtgggataatagttgcagaaaggaagggcaaacaaggaaaggaaggcaagtttaccttggtggttatgataaggaagaaaaagcagcaaaggcttacgacttagctgcactcaagtattggggtccaacaactcacataaatttccctttaagcacttatgagaaggaacttgaagagatgaagcacatgaccaggcaagaatttgtcgccaatttaagaaggaagagcagtggattttcaagaggggcatctgtgtatagaggtgtgacaagacaccatcaacatggaaggtggcaggcccgaataggaagggttgcaggaaacaaggacttgtatcttggtacatttagcacacaagaagaagctgctgaagcatatgatatagcagcaatcaagttcagaggaacaagtgctgtgaccaactttgacataagtaggtatgatgtgaagagaatctgctcaagctccactcttattgcaggagatcttgcaaaacggtctcctaaagaatcaccagctccggttcctgcctctgacttcaattcgtgcggttcatcgccgatgccgctggtgtctcagccacctcctttggctataactgatggtgaacattctgatgagttgtccaacatgatgtggaatgccaacaacagtgatgagcaagcacagaatgagagtggtggtgctgaattcaacaacaatgtaactgaatcatcatcatcacaacaggtttcaccaagcagcaacaaggatgctttgaaccctcaaagccccaatgagtttggagtcagtggagcagattatggacatggctacttcacccttgatggaccaaaatatgatgatgggaacaatgaaaatgaccacatgagcaccaacaggcttggaaatttgggattggttaatcaagttcccatgtttgctttgtggaatgaatgaagggaatgttatgttgatgagttgagattacaaaaaacattagcttaggaaaaaaaactaagatcagatggcagaattattgaatgattattatattgtagcttggtatggtaactttttattttatgttgaa

SEQ ID NO: 360 - protein, 384 aa, Glycine max
TSLSLTMSPSVQNGVGAISSVQVNEDSRKRVMAKSHAREPVPRKSIDTFGQRTSQYRGVTRHRWTGRYEAHLWDNSCRKEGQTRKGRQVYLGGYDKEEKAAKAYDLAALKYWGPTTHINFPLSTYEKELEEMKHMTRQEFVANLRRKSSGFSRGASVYRGVTRHHQHGRWQARIGRVAGNKDLYLGTFSTQEEAAEAYDIAAIKFRGTSAVTNFDISRYDVKRICSSSTLIAGDLAKRSPKESPAPVPASDFNSCGSSPMPLVSQPPPLAITDGEHSDELSNMMWNANNSDEQAQNESGGAEFNNNVTESSSSQQVSPSSNKDALNPQSPNEFGVSGADYGHGYFTLDGPKYDDGNNENDHMSTNRLGNLGLVNQVPMFALWNE

SEQ ID NO: 361 - DNA, 1990 bp, Glycine max
gcacgagcaagtttcgaaattgaaaagggtgggagagatacaaagtgttcattgatttaaacccttgctagaacccttggtggtttttgattttgtgaaaggtaaagcaagcaaataagggctcaatgaacaacaactggctttcgttccctctttctcctactcattcttccttaccagctcatgatcttcaagcaactcaatatcatcaattttcccttgggttagtgaacgagaacatggataaccctttccaaaatcatgattggaatctgattaacacccatagtagcaacgaaattccaaaagtggctgattttctaggagtgagcaagtctgaaaatcagtcagaccttgcagccttaaacgaaattcattcaaatgattcagattatctgttcacaaacaacagtctggtgcctatgcaaaaccctgtgttggacacacctagcaatgagtatcaagaaaatgctaatagtaatttgcaatcattgacattatccatgggaagtggtaaggattcaacatgtgaaaccagtggtgaaaatagcacaaacactactgttgaagttgcacctagaagaactttggatacattcgggcagagaacatccatatatcgtggagtaactcgacatagatggactggaaggtatgaagctcatctttgggataatagctgtagaagggaaggccaatcaagaaaaggacgccaagtttatttgggtggatatgataaagaagagaaagcagctagagcttatgatttagctgcactgaagtactgggggacatccaccactaccaactttccaattagcaactatgagaaggaattggatgaaatgaaacacatgacgagacaagaatttgttgccgccattagaaggaaaagcagtggtttctccaggggtgcatcaatgtatcgtggagttacaaggcatcaccaacacggaagatggcaagcaaggattggcagagttgcaggaaacaaagatctttacttgggaactttcagtactgaggaagaggctgcagaagcatacgacatagcagcgataaagttcagaggtctcaacgctgtcacaaactttgacatgagccgctacgacgtgaaagccattcttgaaagcaacactctcccaataggaggaggcgctgcaaagcgtctgaaagaagctcaagctctagaatcttcgagaaaacgcgaagagatgattgcactaggctcatcttccacgttccaatacggaacctcagcaagctcttctaggcttcacgcttaccctctaatgcagcaccaccaccagttcgagcaacctcaacctctgctaactcttcaaaaccacgacataagttcttctcacttctctcaccagcaagaccctttgcatcatcagggttacatccaaacgcagcttcagttgcaccagcagagtggcgcttcttcttatagctttcagaataatgctcagttctacaatggttaccttcagaaccaccctgcattgcttcagggaatgatgaacatggggtcttcttcttcttcctcatctgtgttggagaataataatagtaacaataataataataatgttggtgggtttgtgggaagtgggtttggtatggcttcgaatgcaacggcggggaacacggtggggacagcggaggagttagggctggtgaaggtggactatgacatgccggctggaggttacggtggctggtcggcggcggactccatgcagacgtcaaatggtggggtgttcacaatgtggaatgattaaggaagggaagctagttctagtatgggacaacgtactagttagttgccatacaattttgttatgcatttttatttttttgtctttgggtttttaatattctcgcaattggaaaagaaaaataggtgctgattttctgtgagacattgatcacaaaggaagtgagaaaagaccatatatctattataaaaaaaaaaaaaaaaaaa

SEQ ID NO: 362 - protein, 553 aa, Glycine max
MNNNWLSFPLSPTHSSLPAHDLQATQYHQFSLGLVNENMDNPFQNHDWNLINTHSSNEIPKVADFLGVSKSENQSDLAALNEIHSNDSDYLFTNNSLVPMQNPVLDTPSNEYQENANSNLQSLTLSMGSGKDSTCETSGENSTNTTVEVAPRRTLDTFGQRTSIYRGVTRHRWTGRYEAHLWDNSCRREGQSRKGRQVYLGGYDKEEKAARAYDLAALKYWGTSTTTNFPISNYEKELDEMKHMTRQEFVAAIRRKSSGFSRGASMYRGVTRHHQHGRWQARIGRVAGNKDLYLGTFSTEEEAAEAYDIAAIKFRGLNAVTNFDMSRYDVKAILESNTLPIGGGAAKRLKEAQALESSRKREEMIALGSSSTFQYGTSASSSRLHAYPLMQHHHQFEQPQPLLTLQNHDISSSHFSHQQDPLHHQGYIQTQLQLHQQSGASSYSFQNNAQFYNGYLQNHPALLQGMMNMGSSSSSSSVLENNNSNNNNNNVGGFVGSGFGMASNATAGNTVGTAEELGLVKVDYDMPAGGYGGWSAADSMQTSNGGVFTMWND

SEQ ID NO: 363 - DNA, 1479 bp, Triticum aestivum
acgacgcagtcacgcaccggctctttcctccacccctcgtagggctagctagggtttctccgcccaaatcgtgtaataataacccacttgaagattcgcgcgaaagctgcggcgatggccaccaccgtccaaccccactccccggacccaacagccatcaccaccacccctgcccctccccctcctccttctccacctcgccaggagaacccgaccgccgcgggggaaggcgtagagatcgcggcgctcgatgagcagcctgccgccgtcgccgtcgccgacaaggggaagacggcccccggcggcgggaagctggtggcggaggccatgcgcaagtgcgcggcgccccggtcgtcgcgctaccacggcgtgacgaggctcaagtggagcggcaagtacgaggcacacctctgggacaacaccagccaggttgaggggcgcaagcgcaagggcaagcatgtgtacttgggaagctatgttactgaagagaatgctgcaagggcacatgaccttgcagccctgaaatattggggcataactcaacccaccaaactaaacttcaatatttctgattatgcaaaagaaattgagatcatgaagagcatgaatcaagatgaatttgtggcctacataaggaggcagagtagttgtttctcaagaggaacatcgtcatacaggggtgtaacaagacgaaaggatggtaaatggcaagcacgtattggtaggattggtgagagtagagacactaaagacatctatcttgggacctttgaaactgaagtggaggcagctgaagcgtatgacctagcagcaattcagctccgtggtgttcatgctgtgaccaactttgatatcagcaactactccgaagaaggtttgaagaaactagaaggctcatctgaggtagtgaacctggaggaccaatcagaagtcactaagttagctgtgaccaacttggatattagcaaacactgcgaagatggtttgaagaaactagatggcgcatcccaggtagtgaacctggagggccaatcagaagtcaccaagttatctgtgactaactttgatattagcaactgctgtgaagatggtttgaagaaactagaaggctcatccgaggtagcgaacctggaggaccaatcagaagtcacaaagttagctggacaatagatattagaatagcaacatgtaaattatttatttcttcctttttatcttttctctgatcgtcaatctctccacctttctcttttcttgattgatgatgagagtgtcttttcttcgtctgcctttcctgaaacttttttttcccaaggaatttcccttcgctggttgccaactctattatttaccagctccagagtaggatcgtgtgatgctgtactctgtattctcatgtacactgattacaaaccattgatagtatttgtagacattacaacacaaaggaagttcattcttctatttttgtaaaaaaaa

SEQ ID NO: 364 - protein, 351 aa, Triticum aestivum
MATTVQPHSPDPTAITTTPAPPPPPSPPRQENPTAAGEGVEIAALDEQPAAVAVADKGKTAPGGGKLVAEAMRKCAAPRSSRYHGVTRLKWSGKYEAHLWDNTSQVEGRKRKGKHVYLGSYVTEENAARAHDLAALKYWGITQPTKLNFNISDYAKEIEIMKSMNQDEFVAYIRRQSSCFSRGTSSYRGVTRRKDGKWQARIGRIGESRDTKDIYLGTFETEVEAAEAYDLAAIQLRGVHAVTNFDISNYSEEGLKKLEGSSEVVNLEDQSEVTKLAVTNLDISKHCEDGLKKLDGASQVVNLEGQSEVTKLSVTNFDISNCCEDGLKKLEGSSEVANLEDQSEVTKLAGQ

SEQ ID NO: 365 - protein, 1029 aa, [Arabidopsis thaliana] [sequence omitted]

SEQ ID NO: 366 - protein, 481 aa, Arabidopsis thaliana
  misc_feature: gi 7488207
MSDSGGGSHKSSTTKPSVFGLNLYLVIAICSVFILLISLLIFLFVCLNRVSRARRMRVKHSSGSIPLVSKEISEIKTVGKFINSDDSKGKIGNEVVVVVSATSKEATSGFDTLSVASSGDVGTSEAMGWGKWYSLKDLEIATRGFSDDNMIGEGGYGVVYRADFSDGSVAAVKNLLNNKGQAEKEFKVEVEAIGKVRHKNLVGLMGYCADSAQSQRMLVYEYIDNGNLEQWLHGDVGPVSPLTWDIRMKIAIGTAKGLAYLHEGLEPKVVHRDVKSSNILLDKKWNAKVSDFGLAKLLGSETSYVTTRVMGTFGYVSPEYASTGMLNECSDVYSFGVLLMEIITGRSPVDYSRPPGEMNLVDWFKGMVASRRGEEVIDPKIKTSPPPRALKRALLVCLRCIDLDSSKRPKMGQIIHMLEAEDFPFRPVSVSKAKKRFDPLCNLLILSFMLSHRNTDQTRKDRSKKDYWANNNVLGKTTLER

SEQ ID NO: 367 - protein, 518 aa, [Nicotiana tabacum]
  misc_feature: gi 1362112
MAGLEELKKKLVPLFDAEKGFSPASTSDPFDSYSLSDGGTVNLLSQSYGVYNINELGLQKCTSWPVDDADHGEKTYKCASHEMRVFGAIGSGASSVVQRAIHIPTHRIIALKKINIFEKEKRQQLLTEIRTLCEAPCCQGLVEFYGAFYTPDSGQISIALEYMDGGSLADIIKVRKSIPEAILSPMVQKLLNGLSYLHGVRHLVHRDIKPANLLVNLKGEPKITDFGISAGLESSIAMCATFVGTVTYMSPERIRNENYSYPADIWSLGLALFECGTGEFPYTANEGPVNLMLQILDDPSPSLSGHEFSPEFCSFIDACLKKNPDDRLTAEQLLSHPFITKYTDSAVDLGAFVRSIFDPTQRMKDLADMLTIHYYLLFDGSDEFWQHTKTLYNECSTFSFGGKESIGPSNIFSTMSNIRKTLAGEWPPEKLVHVVEKVQCRTHGQDGVAIRVSGSFIVGNQFLICGDGMQVEGLPNLKDLSIDIPSKRMGTFHEQFIVEQANIIGRYFITKQELFITQ

SEQ ID NO: 368 - protein, 799 aa, [Arabidopsis thaliana]
  misc_feature: gi 4006878
MEWIRRETIGHGSFSTVSLATTSGSSSKAFPSLMAVKSSGVVCSAALRNERDVLDDLGDCSEIVRCFGEGRTVENGEEIYNLFLEYASGGSLADRIKSSGEALPEFEVRRFTRSIVKGLCHIHGNGFTHCDIKLENVLVFGDGDVKISDFGLAKRRSGEVCVEIRGTPLYMAPESVNHGEFESPADIWALGCSVVEMSSGKTAWCLEDGVMNNVMSLLVRIGSGDEVPRIPVELSEEGKDFVSKCFVKNAAERWTAEMLLDHPFLAVDDESGEEDEACSVSPRNPFDFPGWNSVQSPVNDSVMFGSLVGSPEERISGLVSEKVPDWSVSCDWVNVSLEMGETCSSTSECDAGLSCQSCPANGNTGSTCTRIQPLNPTSKVNGLPFNKYSWLTTHNSYAITGANSATGSFLVSPKNQEDSITNQLKNGVRGIMLDTYDFQNDIWLCHSTGGTCFNFTAFQPAINALKEINDFLESNLSEIVTIILEDYVKSQMGLTNVFNASGLSKFLLPISRMPKDGTDWPTVDDMVKQNQRLVVFTSKKDKEASEGLAYQWNYMVENQYGNDGMKDGSCSSRSESSSLDTMSRSLVFQNYFETSPNSTQACADNSSPLIEMMRTCHEAAGKRWPNFIAVDFYQRSDSGGAAEAVDEANGRLTCGCDSLVYCKSNAPFGTCDAPPPKSSPSPVSGGRILHGNQEIFLRVMLILQLLDCHLSEISGKADTMVIHTHSTNQTTHICKFSMQFTDRSFVEPEEVDEVIQLGADTNLQSKQLGFSQKQKALNTNRLSVSKQIFSGVLLDYYTL

SEQ ID NO: 369 - protein, 444 aa, [Arabidopsis thaliana]
  misc_feature: gi 7487975
MEINWTRGPIIGRGSTATVSIAISSSGELFAVKSADLSSSSLLQKEQSILSTLSSPHMVKYIGTGLTRESNGLVYNILMEYVSGGNLHDLIKNSGGKLPEPEIRSYTRQILNGLVYLHERGIVHCDLKSHNVLVEENGVLKIADMGCAKSVDKSEFSGTPAFMAPEVARGEEQRFPADVWALGCTMIEMMTGSSPWPELNDVVAAMYKIGFSGESPAIPAWISDKAKDFLKNCLKEDQKQRWTVEELLKHPFLDDDEESQTSDCLKNKTSSPSTVLDQRFWDSCESSKSHLVSIDHEDPFAEYSESLDSPADRIEKLAGDEFSSLLDWDTEDDGGWIQVRGEKHKETEKRDGDEDVICVEATSSSQTIEEVEDWISNQDSLFSEYSSDDIINNFYSNVAIQGNLIAFHYCTDEGENVSIKNMFRTNNKHLFFKLQAHVKFTNQV

SEQ ID NO: 370 - protein, 372 aa, Arabidopsis thaliana
  misc_feature: gi 7487976
MEWTRGRILGRGSTATVYAAAGHNSDEILAVKSSEVHRSEFLQREAKILSSLSSPYVIGYRGSETKRESNGVVMYNLLMEYAPYGTLTDAAAKDGGRVDETRVVKYTRDILKGLEYIHSKGIVHCDVKGSNVVISEKGEAKIADFGCAKRVDPVFESPVMGTPAFMAPEVARGEKQGKESDIWAVGCTMIEMVTGSPPWTKADSREDPVSVLYRVGYSSETPELPCLLAEEAKDFLEKCLKREANERWTATQLLNHPFLTTKPDIEPVLVPGLISNSPTSVTDQTFWRSVEEEEEEETEEIQKDSRDLDRLSLWGCYSERIGRLKCVGGLDGTRCDMEGGDWIMVRARCEGTMISGSQKELIISENVLVGEL

SEQ ID NO: 371 - protein, 272 aa, Arabidopsis thaliana
  misc_feature: gi 11282597
MQSKPGRENEEEVNNHHAVQQPMMYAEPWWKNNSFGVVPQARPSGIPSNSSSLDCPNGSESNDVHSASEDGALNGENDGTWKDSQAATSSRSVDNHGMEGNDPALSIRNMHDQPLVQPPELVGHYIACVPNPYQDPYYGGLMGAYGHQQLGFRPYLGMPRERTALPLDMAQEPVYVNAKQYEGILRRRKARAKAELERKVIRDRKPYLHESRHKHAMRRARASGGRFAKKSEVEAGEDAGGRDRERGSATNSSGSEQVETDSNETLNSSGAP

SEQ ID NO: 372 - protein, 215 aa, Vitis riparia
  misc_feature: gi 7141243
MMPMTMAEYHLAPPSQLELVGHSIVQSQFLGVNVARMALPIEMAEEPVYVNAKQYHGILRRRQSRAKAELEKKLIKVRKPYLHESRHQHAMRRARGCGGRFLNTKKLDSNASYDMPDKGSDPDVNLSTRPISSSVSESLPFNSSRNEDSPTSHLDARGPSVQELHNRQTSSMEMATSLLSTQPGISVGRTYHSLKMMIGVERRRPRKAASIREFW

SEQ ID NO: 373 - protein, 238 aa, Oryza sativa
  misc_feature: gi 7489565
MLPPHLTENGTVMIQFGHKMPDYESSATQSTSGSPREVSGMSEGSLNEQNDQSGNLDGYTKSDEGKMMSALSLGKSETVYAHSEPDRSQPFGISYPYADSFYGGAVATYGTHAIMHPQIVGVMSSSRVPLPIEPATEEPIYVNAKQYHAILRRRQLRAKLEAENKLVKNRKPYLHESRHQHAMKRARGTGGRFLNTKQQPEASDGGTPRLVSANGVVFSKHEHSLSSSDLHHRAKEGA

SEQ ID NO: 374 - protein, 197 aa, Arabidopsis thaliana
  misc_feature: gi 6634774
MTHTTENTNKNRATGRDNIGSHEKQEQRDSHFQPPIPSARNYESIVTSLVYSDPGTTNSMAPGQYPYPDPYYRSIFAPPPQPYTGVHLQLMGVQQQGVPLPSDAVEEPVFVNAKQYHGILRRRQSRARLESQNKVIKSRKPYLHESRHLHAIRRPRGCGGRFLNAKKEDEHHEDSSHEEKSNLSAGKSAMAASSGTS

SEQ ID NO: 375 - protein, 298 aa, Arabidopsis thaliana
  misc_feature: gi 9293997
MHSKSDSGGNKVDSEVHGTVSSSINSLNPWHRAAAACNANSSVEAGDKSSKSIALALESNGSKSPSNRDNTVNKESQVTTSPQSAGDYSDKNQESLHHGITQPPPHPQLVGHTVGWASSNPYQDPYYAGVMGAYGHHPLGFVPYGGMPHSRMPLPPEMAQEPVFVNAKQYQAILRRRQARAKAELEKKLIKSRKPYLHESRHQHAMRRPRGTGGRFAKKTNTEASKRKAEEKSNGHVTQSPSSSNSDQGEAWNGDYRTPQGDEMQSSAYKRREEGECSGQQWNSLSSNHPSQARLAIK

SEQ ID NO: 376 - protein, 340 aa, Arabidopsis thaliana
  misc_feature: gi 5903072
MMHQMLNKKDSATHSTLPYLNTSISWGVVPTDSVANRRGSAESLSLKVDSRPGHIQTTKQISFQDQDSSSTQSTGQSYTEVASSGDDNPSRQISFSAKSGSEITQRKGFASNPKQGSMTGFPNIHFAPAQANFSFHYADPHYGGLLAATYLPQAPTCNPQMVSMIPGRVPLPAELTETDPVFVNAKQYHAIMRRRQQRAKLEAQNKLIRARKPYLHESRHVHALKRPRGSGGRFLNTKKLLQESEQAAAREQEQDKLGQQVNRKTNMSRFEAHMLQNNKDRSSTTSGSDITSVSDGADIFGHTEFQFSGFPTPINRAMLVHGQSNDMHGGGDMHHFSVHI

SEQ ID NO: 377 - protein, 355 aa, Arabidopsis thaliana
  misc_feature: gi 8778470
MDKKVSFTSSVAHSTPPYLSTSISWGLPTKSNGVTESLSLKVVDARPERLINTKNISFQDQDSSSTLSSAQSSNDVTSSGDDNPSRQISFLAHSDVCKGFEETQRKRFAIKSGSSTAGIADIHSSPSKVPVYLLRVTISSTCDCLLTSCVILWFQANFSFHYADPHFGGLMPAAYLPQATIWNPQMTRVPLPFDLIENEPVFVNAKQFHAIMRRRQQRAKLEAQNKLIKARKPYLHESRHVHALKRPRGSGGRFLNTKKLQESTDPKQDMPIQQQHATGNMSRFVLYQLQNSNDCDCSTTSRSDITSASDSVNLFGHSEFLISDCPSQTNPTMYVHGQSNDMHGGRNTHHFSVHI

SEQ ID NO: 378 - protein, 271 aa, Arabidopsis thaliana
  misc_feature: gi 2398521
MQSKPGRENEEEVNNHHAVQQPMMYAEPWWKNNSFGVVPQARPSGIPSNSSSLDCPNGSESNDVHSASEDGALNGENDGTWKDSQAATSSRSDNHGMEGNDPALSIRNMHDQPLVQPPELVGHYIACVPNPYQDPYYGGLMGAYGHQQLGFRPYLGMPRERTALPLDMAQEPVYVNAKQYEGILRRRKARAKAELERKVIRDRKPYLHESRHKHAMRRARASGGRFAKKSEVEAGEDAGGRDRERGSATNSSGSEQVETDSNETLNSSGAP

SEQ ID NO: 379 - protein, 315 aa, Brassica napus
  misc_feature: gi 1586551
MISLTVTTPSLRMETEDMHSKSESGNQIVSEAHHHTSSTSINSLNPWLRAAASCNANSSVEEAGDKSIALENQTNLESSNGSKSPSNRDENGNKESQVTASPQQSAADYSEKSQELVHPGSTPPPHPQLVSHTVGWASSNPYQDSYYAGMMGAYPLTYVPHGGMPHSRMQLPPEMAQEPVYVNAKQYQAIMRRRQARAKAELEKKLIKSRKRYLHESRHQHAMRRPRGTGGRFAKKTNTEASQQKDGEKRNACATQSPTSSHSDQHEGCSDEYRTNQSDEMQSSAYKIREEADCSGQQWNNISSNHPSQPLLAIK

SEQ ID NO: 380 - protein, 295 aa, Arabidopsis thaliana
  misc_feature: gi 6714441
MAMQTVREGLFSAPQTSWWTAFGSQPLAPESLAGDSDSFAGVKVGSVGETGQRVDKQSNSATHLAFSLGDVKSPRLVPKPHGATFSMQSPCLELGFSQPPIYTKYPYGEQQYYGVVSAYGSQSRVMLPLNMETEDSTIYVNSKQYHGIIRRRQSRAKAAAVLDQKKLSSRCRKPYMHHSRHLHALRRPRGSGGRFLNTKSQNLENSGTNAKKGDGSMQIQSQPKPQQSNSQNSEVVHPENGTMNLSNGLNVSGSEVTSMNYFLSSPVHSLGGMVMPSKWIAAAAAMDNGCCNFKT

SEQ ID NO: 381 - protein, 205 aa, Oryza sativa
  misc_feature: gi 5257260
MEPKSTTPPPPPPPPVLGAPVPYPPAGAYPPPVGPYAHAPPLYAPPPPAAAAASAAATAASQQAAAAQLQNFWAEQYREIEHTTDFKNHNLPLARIKKIMKADEDVRMIAAEAPVVFARACEMFILELTHRGWAHAEENKRRTLQKSDIAAAIARTEVFDFLVDIVPRDEAKDAEAAAAVAAGIPHPAAGLPATDPMAYYYVQPQ

SEQ ID NO: 382 - protein, 234 aa, Arabidopsis thaliana
  misc_feature: gi 6523090
MDTNNQQPPPSAAGIPPPPPGTTISAAGGGASYHHLLQQQQQQLQLFWTYQRQEIEQVNDFKNHQLPLARIKKIMKADEDVRMISAEAPILFAKACELFILELTIRSWLHAEENKRRTLQKNDIAAAITRTDIFDFLVDIVPRDEIKDEAAVLGGGMVVAPTASGVPYYYPPMGQPAGPGGMMIGRPAMDPNGVYVQPPSQAWQSVWQTSTGTGDDVSYGSGGSSGQGNLDGQG

SEQ ID NO: 383 - protein, 217 aa, Arabidopsis thaliana
  misc_feature: gi 3776575
MDQQGQSSAMNYGSNPYQTNAMTTTPTGSDHPAYHQIHQQQQQQLTQQLQSFWETQFKEIEKTTDFKNHSLPLARIKKIMKADEDVRMISAEAPVVFARACEMFILELTLRSWNHTEENKRRTLQKNDIAAAVTRTDIFDFLVDIVPREDLRDEVLGGVGAEAATAAGYPYGYLPPGTAPIGNPGMVMGNPGAYPPNPYMGQPMWQQPGPEQQDPDN

SEQ ID NO: 384 - protein, 231 aa, Arabidopsis thaliana
  misc_feature: gi 6289057
MDQQDHGQSGAMNYGTNPYQTNPMSTTAATVAGGAAQPGQLAFHQIHQQQQQQQLAQQLQAFWENQFKEIEKTTDFKKHSLPLARIKKIMKADEDVRMISAEAPVVFARACEMFILELTLRSWNHTEENKRRTLQKNDIAAAVTRTDIFDFLVDIVPREDLRDEVLGSIPRGTVPEAAAAGYPYGYLPAGTAPIGNPGMVMGNPGGAYPPNPYMGQPMWQQQAPDQPDQEN

SEQ ID NO: 385 - protein, 137 aa, Arabidopsis thaliana
  misc_feature: gi 6056368
MQEIEHTTDFKNHTLPLARIKKIMKADEDVRMISAEAPVIFAKACEMFILELTLRAWIHTEENKRRTLQKNDIAAAISRTDVFDFLVDIIPRDELKEEGLGVTKGTIPSVVGSPPYYYLQQQGMMQHWPQEQHPDES

SEQ ID NO: 386 - protein, 250 aa, Arabidopsis thaliana
  misc_feature: gi 9758288
MDNNNNNNNQQPPPTSVYPPGSAVTTVIPPPPSGSASIVTGGGATYHHLLQQQQQQLQMFWTYQRQEIEQVNDFKNHQLPLARIKKIMKADEDVRMISAEAPILFAKACELFILELTIRSWLHAEENKRRTLQKNDIAAAITRTDIFDFLVDIVPREEIKEEEDAASALGGGGMVAPAASGVPYYYPPMGQPAVPGGMMIGRPAMDPSGVYAQPPSQAWQSVWQNSAGGGDDVSYGSGGSSGHGNLDSQG

SEQ ID NO: 387 - protein, 135 aa, [Zea mays]
  misc_feature: gi 2130123
MSSSRRSSSPDSNDTTDERKRKRMLSNRESARRSRARKQQRLEELVAEVARLQAENAATQARTAALERDLGRVDGDNAVVRARHAELAGRLQSLGGVLEVLQMAGAAVDIPEMVTDDPMLRPWQPSFPPMQPIGF

SEQ ID NO: 388 - protein, 148 aa, [Oryza sativa]; identical to SEQ ID NO: 150
  misc_feature: gi 479696

SEQ ID NO: 389 - protein, 146 aa, Arabidopsis thaliana
  misc_feature: gi 7340713
MGSLQMQTSPESDNDPRYATVTDERKRKRMISNRESARRSRMRKQKQLGDLINEVTLLKNDNAKITEQVDEASKKYIEMESKNNVLRAQASELTDRLRSLNSVLEMVEEISGQALDIPEIPESMQNPWQMPCPMQPIRASADMFDC

SEQ ID NO: 390 - protein, 167 aa, Capsicum chinense
  misc_feature: gi 4457221
MASSSGTSSGSSFLQNSGSEEDLQLLMDQRKRKRMISNRESARRSRMRKQKHLDDLMAQVSTLRKENDQILTSMNVTTQHYLNVEAENSILRAQLSELSHRLESLNEIIAYMDANNSCSNGLAMDHNEPYSFNFAQSDTVVDGFNMTNSWNYFCSNQPIMTAHVLQY

SEQ ID NO: 391 - protein, 245 aa, Sesamum indicum
  misc_feature: gi 6478218
MATHVLAAAAERNAALAPDAPLAPVTMERPVRTDLETSIPKPYMARGLVAPDMDHPNGTPGHVHDNLSVLQQHCAFFDQDDNGIIYPWETYSGLRQIGFNVIASLIMAIVINVALSYPTLPGWIPSPFFPIYLYNIHKAKHGSDSGTYDTEGRYLPMNFENLFSKHARTMPDRLTLGELWSMTEANREAFDIFGWIASKMEWTLLYILARDQDGFLSKEAIRRCYDGSLFEYCAKMQRGAEDKMK

SEQ ID NO: 392 - protein, 244 aa, [Oryza sativa] [sequence omitted]

SEQ ID NO: 393 - protein, 236 aa, [Arabidopsis thaliana]
  misc_feature: gi 2459421
MAGEAEALATTAPLAPVTSQRKVRNDLEETLPKPYMARALAAPDTEHPNGTEGHDSKGMSVMQQHVAFFDQNDDGIVYPWETYKGFRDLGFNPISSIFWTLLINLAFSYVTLPSWVPSPLLPVYIDNIHKAKHGSDSSTYDTEGRYVPVNLENIFSKYALTVKDKLSFKEVWNVTEGNRMAIDPFGWLSNKVEWILLYILAKDEDGFLSKEAVRGCFDGSLFEQIAKERANSRKQD

SEQ ID NO: 394 - protein, 424 aa, Arabidopsis thaliana
  misc_feature: gi 3482918
MARKKIREYDSKRLLKEHLKRLANIDLQIRSAQVTESTDFTELTNQESWLSSTKLVVKPDMLFGKRGKSGLVALKLDLAEVADFVKARLGTEVEMEGCKAPITTFIVEPFVPHDQEYYLSIVSDRLGCTISFSECGGIEIEENWDKVKTIFLPAEKSMTLEVCAPLIATLPLEVRAKIGNFIMGAFAVFQDLDFSFMEMNPFTLVDGEPFPLDMRGELDDTAAFKNFNKWGDIEFPLPFGRVLSSTENFIHGLDEKTSASLKFTVLNPKGRIWTMVAGGGASVIYADTVGDLGYASELGNYAEYSGAPNEEEVLQYARVVIDCATTDPDGRKRALLIGGGIANFTDVAATFNGIIRALREKETRLKASRMHIYVRRGGPNYQTGLARMRALGEELGVPLEVYGPEATMTGICKRAIDCIMLPDA

SEQ ID NO: 395 - protein, 608 aa, Arabidopsis thaliana
  misc_feature: gi 9759429
MATGQLFSRTTQALFYNYKQLPVQRMLDFDFLCGRETPSVAGIINPGSEGFQKLFFGQEEIAIPVHAAIEAACAAHPTADVFINFASFRSAAASSMAALKQPTIKVVAIIAEGVPESDTKQLIAYARANNKVVIGPATVGGIQAGAFKIGDTAGTIDNIIQCKLYRPGSVGFVSKSGGMSNEMYNTVARVTDGIYEGIAIGGDVFPGSTLSDHILRFNNIPQIKMMVVLGELGGRDEYSLVEALKEGKVNKPVVAWVSGTCARLFKSEVQFGHAGAKSGGEMESAQAKNQALIDAGAIVPTSFEALESAIKETFEKLVEEGKVSPIKEVIPPQIPEDLNSAIKSGKVRAPTHIISTISDDRGEEPCYAGVPMSSIIEQGYGVGDVISLLWFKRSLPRYCTKFIEICIMLCADHGPCVSGAHNTIVTARAGKDLVSSLVSGLLTIGPRFGGAIDDAARYFKDACDRNLTPYEFVEGMKKKGIRVPGIGHRIKSRDNRDKRVELLQKFARSNFPSVKYMEYAVTVETYTLSKANNLVLNVDGAIGSLFLDLLAGSGMFTKQEIDEIVQIGYLNGLFVLARSIGLIGHTFDQKRLKQPLYRHPWEDVLYTK

SEQ ID NO: 396 - protein, 423 aa, Arabidopsis thaliana
  misc_feature: gi 2462746
MARKKIREYDSKRLVKEHFKRLSGQELPIRSVQINQETDLNELVEREPWLSSEKLVVKPDMLFGKRGKSGLVALNLDFADVATFVKERLGKEVEMSGCKGPITTFIVEPFVPHNEEFYLNIVSDRLGCSISFSECGGIDIEENWDKVKTITIPTGASLTFEICAPLVATLPLEIKGELEDFIQVIFTLFEDLDFTFLEMNPFTLVDGKPYPLDMRGELDDTAAFKNFKKWGDIEFPMPFGRVMSSTESFIHGLDEKTSASLKFTVLNPKGRIWTMVAGGGASVIYADTVGDLGYASELGNYAEYSGAPKEDEVLQYARVVIDCATANPDGKSRALVIGGGIANFTDVAATFNGIIRALKEKEAKLKAARMHIFVRRGGPNYQKGLAKMRSLGDEIGVPIEVYGPEATMTGICKEAIQYITAAA

SEQ ID NO: 397 - protein, 674 aa, Sordaria macrospora
MPSATSTNGANGNGNGNGASASPAPGNLSANDNIRRFAAPSRPLSPLPAHALFNEKTRCFVYGLQPRAVQGMLDFDFICKRSTPSVAGIIYTFGGQFVSKMYWGTSETLLPVYQEVQKAIAKHPDVDVVVNFASSRSVYSSTMELMEHPQIKTIAIIAEGVPERRAREIAYVAKKKGITIIGPATVGGIKPGCFKIGNTGGMMDNIVASKLYRKGSVGYVSKSGGMSNELNNIISQTTDGVYEGVAIGGDRYPGTTFIDHLLRYQADPACKILVLLGEVGGVEEYKVIEAVKQGIITKPIVAWAIGTCASMFKTEVQFGHAGAFANSQLETAATKNKSMREAGFYVPDTFEDMPALLKQVYDKLVADGTIVPAPEPVVPKIPIDYSWAQELGLIRKPAAFISTISDDRGQELLYAGMPISDVFREEIGIGGVMSLLWFRRRLPDYAAKFLEMVLMLTADHGPAVSGAMNTIITTRAGKDLISSLVAGLLTIGSRFGGALDGAAEEFTKAFDKGLSPREFVDTMRKQNKLIPGIGHRVKSRNNPDLRVELVKEYVKAKFPSSKLLDYALAVETVTTSKKDNLILNVDGCIAVCFVDLLRNCGAFSTEEAEDYLSMGVLNGLFVLGRSIGLIAHYLDQKRLRTGLYRHPWDDITYLLPSLQQPGPPGTEGRVEVQI

SEQ ID NO: 398 - protein, 572 aa, Arabidopsis thaliana
  misc_feature: gi 3776559
MGCVFGREAATTTTAEAKQAKSSKASSGVVVVGESSVTKSNGVIADDVEKKKNEEANGDKERKSSKGDRRRSTKPNPRLSNPSKHWRGEQVAAGWPSWLSDACGEALNGWVPRKADTFEKIDKIGQGTYSNVYKAKDMLTGKIVALKKVRFDNLEPESVKFMAREILVLRRLDHPNVVKLEGLVTSRMSCSLYLVFQYMDHDLAGLASSPVVKFSESEVKCLMRQLISGLEHCHSRGVLHRDIKGSNLLIDDGGVLKIADFGLATIFDPNHKRPMTSRVVTLWYRAPELLLGATDYGVGIDLWSAGCILAELLAGRPIMPGRTEVEQLHKIYKLCGSPSEDYWKKGKFTHGAIYKPREPYKRSIRETFKDFPPSSLPLIDALLSIEPEDRQTASAALKSEFFTSEPYACEPADLPKYPPSKEIDAKRRDEETRRQRAASKAQGDGARKNRHRDRSNRALPAPEANAELQSNVDRRRLITHANAKSKSEKFPPPHQDGGAMGVPLGASQHIDPTFIPRDMVPSFTSSSFNFSKDEPPTQVQTWSGPLGHPITGVSRKKKDNTKSSKGKRAVVA

SEQ ID NO: 399 - protein, 311 aa, Medicago sativa
  misc_feature: gi 1806142
MEKYEKLEKVGEGTYGKVYKAKELSTGQIVALKKTRLEMDEEGVPPTALREVSLLQMLSQSLYIVRLLNVEHIDKPPKNATHTPSKPLLYLVFEYLDTDLKKFIDTFRKGTNPRPLPNTLVQSFLFQLCKGVAHCHSHGVLHRDLKPQNLLLDQAKGILKIADLGLGRAFTVPLKSYTHEIVTLWYRAPEVLLGSSTYSTGVDIWSVGCIFAEMVRRQALFPGDSEFQQLLNIFKLLGTPTEQQWPGVSSLRDWHVYPRWEPQNLARAVPSLSPDGVDLLTKMLKYNPAERISAKAALDHPYFDSLDKSQY

SEQ ID NO: 400 - protein, 445 aa, Arabidopsis thaliana
  misc_feature: gi 5051782
MVVRKVGKYELGRTIGEGTFAKVKFAQNTETGESVAMKIVDRSTIIKRKMVDQIKREISIMKLVRHPCVVRLYEVLASRTKIYIILEYITGGELFDKIVRNGRLSESEARKYFHQLIDGVDYCHSKGVYHRDLKPENLLLDSQGNLKISDFGLSALPEQGVTILKTTCGTPNYVAPEVLSHKGYNGAVADIWSCGVILYVLMAGYLPFDEMDLPTLYSKIDKAEFSCPSYFALGAKSLINRILDPNPETRITIAEIRKDEWFLKDYTPVQLIDYEHVNLDDVYAAFDDPEEQTYAQDGTRDTGPLTLNAFDLIILSQGLNLATLFDRGKDSMKHQTRFISHKPANVVLSSMEVVSQSMGFKTHIRNYKMRVEGLSANKTSHFSVILEVFKVAPSILMVDIQNAAGDAEEYLKFYKTFCSKLDDIIWKPPDASMRNRVTKAKSKRR

SEQ ID NO: 401 - protein, 509 aa, Oryza sativa
  misc_feature: gi 4107001
MEGNARGGGHSEALKNYNLGRTLGIGSFGKVKIAEHKLTGHRVAIKILNRRQMRNMEMEEKAKREIKILRLFIHPHIIRLYEVIYTPTDIYVVMEYCKFGELFDYIVEKGRLQEDEARRIFQQIISGVEYCHRNMVVHRDLKPENLLLDSKYNVKLADFGLSNVMHDGHFLKTSCGSPNYAAPEVISGKLYAGPEVDVWSCGVILYALLCGTLPFDDENIPNLFKKIKGGIYTLPSHLSALARDLIPRMLVVDPMKRITIREIREHQWFQIRLPRYLAVPPPDTAQQAKMIDEDTLQDVVNLGYEKDHVCESLRNRLQNEATVAYYLLLDNRFRATSGYLGADYQESLERNLNRFASSESASSNTRHYLPGSSDPHASGLRPHYPVERKWALGLQSRAQPREIMIEVLKALEDLNVCWKKNGQYNMKCRWSVGYPQATDMLDVNHSFVDDSIIMDNGDVNGRLPAVIKFEIQLYKSRDEKYLLDMQRVTGPQLLFLDFCAAFLTKLRVL

SEQ ID NO: 402 - protein, 505 aa, Oryza sativa
  misc_feature: gi 4107009
MEGAGRDGNPLGGYRIGKTLGIGSFGKVKIAEHILTGHKVAIKILNRRKIKSMEMEEKVKREIKILRLFMHPHIIRLYEVIDTPADIYVVMEYVKSGELFDYIVEKGRLQEEEARRFFQQIISGVEYCHRNMVVHRDLKPENLLLDSKCNVKIADFGLSNVMRDGHFLKTSCGSPNYAAPEVISGKLYAGPEVDVWSCGVILYALLCGTLPFDDENIPNLFKKIKGGIYTLPSHLSPLARDLIPRMLVVDPMKRITIREIREHQWFTVGLPRYLAVPPPDTAQQVKKLDDETLNDVINMGFDKNQLIESLHKRLQNEATVAYYLLLDNRLRTTSGYLGAEFHESMESSLAQVTPAETPNSATDHRQHGHMESPGFGLRHHFAADRKWALGLQSRAHPREIITEVLKALQELNVCWKKIGHYNMKCRWSPSFPSHESMMHNNHGFGAESAIIETDDSEKSTHTVKFEIQLYKTRDEKYLLDLQRVSGPQLLFLDLCSAFLTQLRVL

SEQ ID NO: 403 - protein, 257 aa, Arabidopsis thaliana
  misc_feature: gi 4895200
MAQFTGRVVGDYLVGRQIGSGSFSVVWEARHRVDGTEVAIKEIAMDRLNKKLQESLMSEIFILRRINHPNIIRLIDMIKSPGKVHLVLEYCKGGDLSVYVQRHGIVPEATAKHFMQQLAAGLQVLRDNNIIHRDLKPQNLLLSTNENDADLKIADFGFARSLQPRGLAETLCGSPLYMAPEIMQLQKYDAKADLWSVGAILFQLVTGRTPFTGNSQIQLLQNIIRSTELHFPGDCRDLSLDCIDLCQKLLRRNPGQH

SEQ ID NO: 404 - protein, 691 aa, Arabidopsis thaliana
  misc_feature: gi 7630013
MAQSSLVAAAGRSGRVIGDYAVGRQIGSGSFSVVWEGRHLVHGTVVAIKEIAMARLNKKLQESLMSEIIILRKINHPNIIRFIDMIEAPGKINLVLEYCKGGDLSMYIHKHGSVPEATAKHFMLQLAAGLQVLRDNNIIHRDLKPQVLSFLKQNLLLSTDDNDAALKIADFGFARSLQPRGLAETLCGSPLYMAPEIMQLQKYDAKLLQNIIRSTELHFPADCRDLSTDCKDLCQKLLRRNPVERLTFEEFFHHPFLSDKQSYDFTRSRLDSRTMNDFHSSGSSPSRNIEEISQEDGLPFFLDDDSSGPEGSPSSFKHTSPMKSSYGFSVERREAALSPLKNMDLSSRYSRVSHRAETNNFKFEGHRLSDRSQFKPSSLPDSRSFSTQGRGDSPDSMDQDYVLISGPPVDIPSSSSGSPKPFNYPFKSHSPPVEFIKRNVTNLTAPMPIASATGNNLSRFGSLESQNCIPGTSHGSLDLVDAFEQPSTNSLTRIRSLQKCAAAIAELVHERGENGKHLEAFSIQLVILAIWNQALHICHTQAVSGIEGSLLQDINRVGRNISHGGSEKLLPQIQKEFVQEVERAEELAKFVESDNAKMPDAMEMILQAALALGISGGVDEVMGDAENAGNLYSKAVRLLVFLAVEAQTLILNPPLTLTNSVRYRLRTYIDSLITRLKHLQSHRRTSYPQKQ

SEQ ID NO: 405 - protein, 294 aa, Sesbania rostrata
  misc_feature: gi 1835258
MEQYEKVEKIGEGTYGVVYKARDRVTNETIALKKIRLEQEDEGVPSTAIREISLLKEMQHRNIIRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPGILLGSRHYSTPVDIWSVGCIFAEMVNRRPLFPGDSEIDELFKIFRILGTPNEDTWPGVTSLPDFKSTFPKWPPKDLATVVPNLEQAGLNLLSSMLCLDPSKRITARSAVEHEYFKDIKFVP

SEQ ID NO: 406 - protein, 441 aa, Arabidopsis thaliana [sequence omitted]

SEQ ID NO: 407 - protein, 504 aa, Cucumis sativus
  misc_feature: gi 1743009
MDMNVPNYKLGKTLGIGSFGKVKIAEHALTGHKVAIKILNRRKIKNLDMEEKVRREIKILRLFMHPHIIRLYEVIETPSDIYVVMEYVKSGELFDYIVEKGRLQEDEARNFFQQIISGVEYCHRNMVVHRDLKPENLLLDSKCNVKIADFGLSNIMRDGHFLKTSCGSPNYAAPEVISGKLYAGPEVDVWSCGVILYALLCGTLPFDDENIPNLFKKIKGGIYTLPSHLSSGARELIPSMLVVDPMKRITIPEIRQHPWFQAHLPRYLAVPPPDTMQQAKKIDEDILQEVVKMGFDRNQLVESLRNRIQNEATVAYYLLLDNRFRVSSGYLGAEFQETMETGFNRMHPSDPTNPAVGHRLPGYMDYQGMGLRAQFPVERKWALGLQSRAHPREIMTEVLKALRELNVAWKKIGHYNMKCRWLPGIPGHHEGMINNPVHSNHYFGDKSTIIENDGVVKSPNVIKFEVQLYKTREEKYLLDLQRVQGPQFLFLDLCAAFLAQLRVL

SEQ ID NO: 408 - protein, 514 aa, Glycine max
  misc_feature: gi 4567091
MDRSTGRGGGGSVDMFLRNYKLGKTLGIGSFGKVKIAEHVRTGHKVAIKILNRHKIKNMEMEEKVRREIKILRLFMHHHIIRLYEVVETPTDIYVVMEYVKSGELFDYIVEKGRLQEDEARHFFQQIISGVEYCHRNMVVHRDLKPENLLLDSKFNIKIADFGLSNIMRDGHFLKTSCGSPNYAAPEVISGKLYAGPEVDVWSCGVILYALLCGTLPFDDENIPNLFKKIKGGIYTLPSHLSPGARDLIPRMLVVDPMKRMTIPEIRQHPWFQVHLPRYLAVPPPDTLQQAKKIDEEILQEVVNMGFDRNQLVESLSNRIQNEGTVTYYLLLDNRFRVSSGYLGAEFQETMDSGFNRMHSGEVASPVVGHHSTGYMDYQGVGMRQQFPVERKWALGLQSRAQPREIMTEVLKALQELNVCLEEDWTLYHECRWVAGTAGHHEMINNSLHSNHYFGNDSGIIENEAVSKSNVVKFEVQLYKTREEKYLLDLQRVQGPQFLFLDLCAAFLSQLRVL

SEQ ID NO: 409 - protein, 441 aa, Arabidopsis thaliana
  misc_feature: gi 3885328
MNRRQQVKRRVGKYEVGRTIGEGTFAKVKFARNSETGEPVALKILDKEKVLKHKMAEQIRREIATMKLIKHPNVVQLYEVMASKTKIFIILEYVTGGELFDKIVNDGRMKEDEARRYFQQLIHAVDYCHSRGVYHRDLKPENLLLDSYGNLKISDFGLSALSQQVRDDGLLHTSCGTPNYVAPEVLNDRGYDGATADMWSCGVVLYVLLAGYLPFDDSNLMNLYKKISSGEFNCPPWLSLGAMKLITRILDPNPMTRVTPQEVFEDEWFKKDYKPPVFEERDDSNMDDIDAVFKDSEEHLVTEKREEQPAAINAFEIISMSRGLNLENLFDPEQEFKRETRITLRGGANEIIEKIEEAAKPLGFDVQKKNYKMRLENVKAGRKGNLNVATEIFQVAPSLHMVQVSKSKGDTLEFHKFYKKLSNSLEQVVWTNNEVKKETAK

SEQ ID NO: 410 - protein, 302 aa, Oryza sativa
  misc_feature: gi 1944504
MDLYEKLEKVGEGTYGKVYKAREKATGRIVALKKTRLPEDDEGVPPTALREVSLLRMLSQDSHVVRLLDLKQGQNKEGQTILYLVFEYMDTDLKKFIRAHRQNLQKIPVPTVKILMYQLCKGVAFCHGRGVLHRDLKPHNLLMDRKTMALKIADLGLSRSFTVPLKKYTHEILTLWYRAPEVLLGAAHYSTPVDIWSVGCIFAELATNQPLFAGDSEVQQLLHIFKLLGTPNEQVWPGVSKLPNWHEYPQWNPSKVSDLVHGLDADALDLLEKMLQYEPSKRISAKKAMEHPYFNDVNKELY

SEQ ID NO: 411 - protein, 208 aa, Arabidopsis thaliana
  misc_feature: gi 6552738
MTSSVVVAGAGDKNNGIVVQQQPPCVAREQDQYMPIANVIRIMRKTLPSHAKISDDAKETIQECVSEYISFVTGEANERCQREQRKTITAEDILWAMSKLGFDNYVDPLTVFINRYREIETDRGSALRGEPPSLRQTYGGNGIGFHGPSHGLPPPGPYGYGMLDQSMVMGGGRYYQNGSSGQDESSVGGGSSSSINGMPAFDHYGQYK

SEQ ID NO: 412 - protein, 205 aa, Arabidopsis thaliana
  misc_feature: gi 9758795
MAEGSMRPPEFNQPNKTSNGGEEECTVREQDRFMPIANVIRIMRRILPAHAKISDDSKETIQECVSEYISFITGEANERCQREQRKTITAEDVLWAMSKLGFDDYIEPLTLYLHRYRELEGERGVSCSAGSVSMTNGLVVKRPNGTMTEYGAYGPVPGIHMAQYHYRHQNGFVFSGNEPNSKMSGSSSGASGARVEVFPTQQHKY

SEQ ID NO: 413 - protein, 178 aa, Zea mays
  misc_feature: gi 22380
MAEAPASPGGGGGSHESGSPRGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAEGMGQQGAYNQGMGYMQPQYHNGDISN

SEQ ID NO: 414 - protein, 228 aa, Arabidopsis thaliana
  misc_feature: gi 6729485
MAESQTGGGGGGSHESGGDQSPRSLNVREQDRFLPIANISRIMKRGLPLNGKIAKDAKETMQECVSEFISFVTSEASDKCQREKRKTINGDDLLWAMATLGFEDYIDPLKVYLMRYREMEGDTKGSGKGGESSAKRDGQPSQVSQFSQVPQQGSFSQGPYGNSQSLRFGNSIEHLEVLMSSTRTLFITIFRDSTMPVVSENLSDPLSIDMDCEAIYHHFIGLLILSCK

SEQ ID NO: 415 - protein, 161 aa, Arabidopsis thaliana
  misc_feature: gi 2244810
MADSDNDSGGHKDGGNASTREQDRFLPIANVSRIMKKALPANAKISKDAKETVQECVSEFISFITGEASDKCQREKRKTINGDDLLWAMTTLGFEDYVEPLKVYLQKYREVEGEKTTTAGRQGDKEGGGGGGGAGSGSGGAPMYGGGMVTTMGHQFSHHFS

SEQ ID NO: 416 - protein, 187 aa, Arabidopsis thaliana
  misc_feature: gi 2398529
RDRDSGGGQNGNNQNGQSSLSPREQDRFLPIANVSRIMKKALPANAKISKDAKETMQECVSEFISFVTGEASDKCQKEKRKTINGDDLLWAMTTLGFEDYVEPLKVYLQRFREIEGERTGLGRPQTGGEVGEHQRDAVGDGGGFYGGGGGMQYHQHHQFLHQQNHMYGATGGGSDSGGGAASGRTRT

SEQ ID NO: 417 - protein, 160 aa, Arabidopsis thaliana
  misc_feature: gi 3738293
MAGNYHSFQNPIPRYQNYNFGSSSSNHQHEHDGLVVVVEDQQQEESMMVKEQDRLLPIANVGRIMKNILPANAKVSKEAKETMQECVSEFISFVTGEASDKCHKEKRKTVNGDDICWAMANLGFDDYAAQLKKYLHRYRVLEGEKPNHHGKGGPKSSPDN

SEQ ID NO: 418 - protein, 228 aa, Arabidopsis thaliana; identical to SEQ ID NO: 414
  misc_feature: gi 6729485

SEQ ID NO: 419 - protein, 436 aa, Arabidopsis thaliana
  misc_feature: gi 2887500
MASVSSSDQGPKTEAGCSGGGGGESSETVAASDQMLLYRGFKKAKKERGCTAKERISKMPPCTAGKRSSIYRGVTRHRWTGRYEAHLWDKSTWNQNQNKKGKQVYLGAYDDEEAAARAYDLAALKYWGPGTLINFPVTDYTRDLEEMQNLSREEYLASLRRKSSGFSRGIAKYRGLQSRWDASASRMPGPEYFSNIHYGAGDDRGTEGDFLGSFCLERKIDLTGYIKWWGANKNRQPESSSKASEDANVEDAGTELKTLEHTSHATEPYKAPNLGVLCGTQRKEKEISSPSSSSALSILSQSPAFKSLEEKVLKIQESCNNENDENANRNIINMEKNNGKAIEKPVVSHGVALGGAAALSLQKSMYPLTSLLTAPLLTNYNTLDPLADPILWTPFLPSGSSLTSEVRSHISIEPETSEVTKTETSCSTYSYLPQEK

SEQ ID NO: 420 - protein, 205 aa, Arabidopsis thaliana
  misc_feature: gi 11357162
MKKRLTTSTCSSSPSSSVSSSTTTSSPIQSEAPRPKRAKRAKKSSPSGDKSHNPTSPASTRRSSIYRGVTRHRWTGRFEAHLWDKSSWNSIQNKKGKQGAYDSEEAAAHTYDLAALKYWGPDTILNFPAETYTKELEEMQRVTKEEYLASLRRQSSGFSRGVSKYRGVARHHHNGRWEARIGRVFGNKYLYLGTYSTLSPFPFFF

SEQ ID NO: 421 - protein, 485 aa, Zea mays
  misc_feature: gi 7489754
MDMDMSSAYPHHWLSFSLSNNYHHGLLEAFSNSSGTPLGDEQGAVEESPRTVEDFLGGVGCVGAPRSRRLQIRITSLCAASCGSITARFLRHYPAAQSGTTVGEPLSRFTLAAMSSTDVAWAESDQASRSAETFGQRTSIYRGVTRHRWTGRYEAHLWENSCRREGQSRKGRQVYLGGYDKEEKAARAYDLAALKFWGPTTTTNFQVSNYEKELEEMKSMTRQEFIASLRRKSSGFSRGASIYRGVTRHHQHGRWQARIGSVAGNKDLYLGTFSTQEEAAEAYDIAAIKFRGLNAVTNLDMSRYDVESILSSDLPVGGGASGRAAAKFPLDSLQPGSAAAMMLAGAAAASQATMPPSEKDYWSLLALHYQQQQEQERQFPASAYEAYGSGGVNVDFTMGTSSGSNNNTGSGVMWGATSGAVVGQQDSSSKQGNGYASNIPYAAAMVSGTAGYEGSTGDNGTWVTTTTSSNTGTAPHYYNYLFGME

SEQ ID NO: 422 - protein, 555 aa, Arabidopsis thaliana
  misc_feature: gi 2129537
MKSFCDNDDNNHSNTTNLLGFSLSSNMMKMGGRGGREAIYSSSTSSAATSSSSVPPQLVVGDNTSNFGVCYGSNPNGGIYSHMSVMPLRSDGSLCLMEALNRSSHSNHHQDSSPKVEDFFGTHHNNTSHKEAMDLSLDSLFYNTTHEPNTTTNFQEFFSFPQTRNHEEETRNYGNDPSLTHGGSFNVGVYGEFQQSLSLSMSPGSQSSCITGSHHHQQNQNQNHQSQNHQQISEALVETSVGFETTTMAAAKKKRGQEDVVVVGQKQIVHRKSIDTFGQRTSQYRGVTRHRWTGRYEAHLWDNSFKKEGHSRKGRQVYLGGYDMEEKAARAYDLAALKYWGPSTHTNFSAENYQKEIEDMKNMTRQEYVAHLRRKSSGFSRGASIYRGVTRHHQHGRWQARIGRVAGNKDLYLGTFGTQEEAAEAYDVAAIKFRGTNAVTNFDITRYDVDRIMSSNTLLSGELARRNNNSIVVRNTEDQTALNAVVEGGSNKEVSTPERLLSFPAIFALPQVNQKMFGSNMGGNMSPWTSNPNAELKTVALTLPQMPVFAAWADS

SEQ ID NO: 423 - protein, 332 aa, Arabidopsis thaliana
  misc_feature: gi 6587812
MEDITRQSKKTSVENETGDDQSATSVVLKAKRKRRSQPRDAPPQRSSVHRGVTRHRWTGRYEAHLWDKNSWNETQTKKGRQGAYDEEDAAARAYDLAALKYWGRDTILNFPLCNYEEDIKEMESQSKEEYIGSLRRKSSGFSRGVSKYRGVAKHHHNGRWEARIGRVFGNKYLYLGTYATQEEAAIAYDIAAIEYRGLNAVTNFDISRYLKLPVPENPIDTANNLLESPHSDLSPFIKPNHESDLSQSQSSSEDNDDRKTKLLKSSPLVAEEVIGPSTPPEIAPPRRSFPEDIQTYFGCQNSGKLTAEEDDVIFGDLDSFLTPDFYSELNDC

SEQ ID NO: 424 - protein, 555 aa, Arabidopsis thaliana
  misc_feature: gi 1171429
MKSFCDNDDNNHSNTTNLLGFSLSSNMMKMGGRGGREAIYSSSTCSAATSSSSVPPQLVVGDNTSNFGVCYGSNPNGGIYSHMSVMPLRSDGSLCLMEALNRSSHSNHHQDSSPKVEDFFGTHHNNTSHKEAMDLSLDSLFYNTTHEPNTTTNFQEFFSFPQTRNHEEETRNYGNDPSLTHGGSFNVGVYGEFQQSLSLSMSPGSQSSCITGSHHHQQNQNQNHQSQNHQQISEALVETSVGFETTTMAAAKKKRGQEDVVVVGQKQIVHRKSIDTFGQRTSQYRGVTRHRWTGRYEAHLWDNSFKKEGHSRKGRQVYLGGYDMEEKAARAYDLAALKYWGPSTHTNFSAENYQKEIEDMKNMTRQEYVAHLRRKSSGFSRGASIYRGVTRHHQHGRWQARIGRVAGNKDLYLGTFGTQEEAAEAYDVAAIKFRGTNAVTNFDITRYDVDRIMSSNTLLSGELARRNNNSIVVRNTEDQTALNAVVEGGSNKEVSTPERLLSFPAIFALPQVNQKMFGSNMGGNMSPWTSNPNAELKTVALTLPQMPVFAAWADS

SEQ ID NO: 425 - protein, 425 aa, Arabidopsis thaliana
  misc_feature: gi 6648171
MKKWLGFSLTPPLRICNSEEEELRHDGSDGTLFFTHHPPVWRYDINFDHHHHDEDVPKVEDLLSNSHQTEYPINHNQTNVNCTTVVNRLNPPGYLLHDQTVVTPHYPNLDPNLSNDYGGFERVGSVSVFKSWLEQGTPAFPLSSHYVTEEAGTSNNISHFSNEETGYNTNGSMLSLALSHGACSDLINESNVSARVEEPVKVDEKRKRLVVKPQVKESVPRKSVDSYGQRTSQYRGVTRHRWTGRYEAHLWDNSCKKEGQTRRGRQAKIGGYDEEEKAARAYDLAALKYWGPTTHLNFPLSNYEKEIEELNNMNRQEFVAMLRRNSSGFSRGASVYRGVTRHHQHGRWQARIGRVAGNKDLYLGTFSTQEEAAEAYDIAAIKFRGLNAVTNFDINRYDVKRICSSSTIVDSDQAKHSPTSSGAGH

SEQ ID NO: 426 - protein, 485 aa, Zea mays; identical to SEQ ID NO: 421
  misc_feature: gi 2652938

SEQ ID NO: 427 - protein, 308 aa, Arabidopsis thaliana
  misc_feature: gi 7715603
MAKVSGRSKKTIVDDEISDKTASASESASIALTSKRKRKSPPRNAPLQRSSPYRGVTRWTGRYEAHLWDKNSWNDTQTKKGRQGAYDEEEAAARAYDLAALKYWGRDTLLNFPLPSYDEDVKEMEGQSKEEYIGSLRRKSSGFSRGVSKYRGVARHHHNGRWEARIGRVFGNKYLYLGTYATQEEAAIAYDIAAIEYRGLNAVTNFDVSRYLNPNAAADKADSDSKPIRSPSREPESSDDNKSPKSEEVIEPSTSPEVIPTRRSFPDDIQTYFGCQDSGKLATEEDVIFDCFNSYINPGFYNEFDYGP

SEQ ID NO: 428 - protein, 516 aa, Arabidopsis thaliana
  misc_feature: gi 4836931
MINPHGGGGEGGEVPKVADFLGVSKSGDHHTDHNLVPYNDIHQTNASDYYFQTNSLLPTVVTCASNAPNNYELQESAHNLQSLTLSMGSTGAAAAEVATVKASPAETSADNSSSTTNTSGGAIVEATPRRTLETFGQRTSIYRGVTRHRWTGRYEAHLWDNSCRREGQSRKGRQGGYDKEEKAARAYDLAALKYWGPSTTTNFPITNYEKEVEEMKNMTRQEFVASIRRKSSGFSRGASMYRGVTRHHQHGRWQARIGRVAGNKDLYLGTFSTEEEAAEAYDIAAIKFRGLNAVTNFEINRYDVKAILESNTLPIGGGAAKRLKEAQALESSRKREEMIALGSNFHQYGAASGSSSVASSSRLQLQPYPLSIQQPFEHLHHHQPLLTLQNNNDISQYHDSFSYIQTQLHLHQQQTNNYLQSSSHTSQLYNAYLQSNPGLLHGFVSDNNNTSGFLGNNGIGIGSSSTVGSSAEEEFPAVKVDYDMPPSGGATGYGGWNSGESAQGSNPGGVFTMWNE

SEQ ID NO: 429 - protein, 540 aa, Arabidopsis thaliana
  misc_feature: gi 9294411
MDNPFQTQEWNMINPHGGGGDEGGEVPKVADFLGVSKPDENQSNHLVAYNDSDYYFHTNSLMPSVQSNDVVVAACDSNTPNNSSYHELQESAHNLQSLTLSMGTTAGNNVVDKASPSETTGDNASGGALAVVETATPRRALDTFGQRTSIYRGVTRHRWTGRYEAHLWDNSCRREGQSRKGRQGGYDKEDKAARSYDLAALKYWGPSTTTNFPITNYEKEVEEMKHMTRQEFVAAIRRKSSGFSRGASMYRGVTRHHQHGRWQARIGRVAGNKDLYLGTFSTEEEAAEAYDIAAIKFRGLNAVTNFEINRYDVKAILESSTLPIGGGAAKRLKEAQALESSRKREAEMIALGSSFQYGGGSSTGSGSTSSRLQLQPYPLSIQQPLEPFLSLQNNDISHYNNNNAHDSSSFNHHSYIQTQLHLHQQTNNYLQQQSSQNSQQLYNAYLHSNPALLHGLVSTSIVDNNNNNGGSSGSYNTAAFLGNHGIGIGSSSTVGSTEEFPTVKTDYDMPSSDGTGGYSGWTSESVQGSNPGGVFTMWNE

SEQ ID NO: 430 - DNA, 25 bp, synthetic construct
acagtacagtacagtacagtacagt

SEQ ID NO: 431 - DNA, 25 bp, synthetic construct
actgtactgtactgtacgtgactgt

SEQ ID NO: 432 - DNA, 35 bp, synthetic construct
ctcaattgcccgggaacatgcaccacggcctgtcg

SEQ ID NO: 433 - DNA, 26 bp, synthetic construct
cccgggctaggacatcttggcgtgct

SEQ ID NO: 434 - DNA, 25 bp, synthetic construct
aattgatgcagggaggggcgacggc

SEQ ID NO: 435 - DNA, 26 bp, synthetic construct
cccgggctaggacatcttggcgtgct

SEQ ID NO: 436 - DNA, 37 bp, synthetic construct
ggcgccaattgatgaagtctttttgtgataatgatga

SEQ ID NO: 437 - DNA, 31 bp, synthetic construct
tcatacccgggtcaagaatcagcccaagcag

SEQ ID NO: 438 - DNA, 30 bp, synthetic construct
aatttctagaatggacagatcaactggccg

SEQ ID NO: 439 - DNA, 36 bp, synthetic construct
gtgatctagactagagaacacgtagctgtgaaagga

SEQ ID NO: 440 - DNA, 31 bp, synthetic construct; identical to SEQ ID NO: 437

SEQ ID NO: 441 - DNA, 31 bp, synthetic construct
cccgggaattcgcaccggattcttccgccgt

SEQ ID NO: 442 - DNA, 26 bp, synthetic construct
caattgatggcgcccaccgtgatgat

SEQ ID NO: 443 - DNA, 30 bp, synthetic construct
cccgggctagccatgcaccggattcttccg

SEQ ID NO: 444 - DNA, 30 bp, synthetic construct; identical to SEQ ID NO: 443

SEQ ID NO: 445 - DNA, 26 bp, synthetic construct
cccgggttacgctgcagccatgatgc

SEQ ID NO: 446 - DNA, 25 bp, synthetic construct
ggatggcgcccaccgtgatgatggc

SEQ ID NO: 447 - DNA, 23 bp, synthetic construct
cgcgccatgcaccggattcttcc

SEQ ID NO: 448 - DNA, 27 bp, synthetic construct
cttcttgcgcgccatgcaccggattct

SEQ ID NO: 449 - DNA, 27 bp, synthetic construct
gtactcccggatcttcttgcgcgccat

SEQ ID NO: 450 - DNA, 30 bp, synthetic construct
cgcttggagtcgtactcccggatcttcttg

SEQ ID NO: 451 - DNA, 34 bp, synthetic construct
gcttcctgaggaggcgcttggagtcgtactcccg

SEQ ID NO: 452 - DNA, 24 bp, synthetic construct
atggctagcgggcaacttttctca

SEQ ID NO: 453 - DNA, 34 bp, synthetic construct
gtacccccgggtcacttggtgtaaagtacatcct

SEQ ID NO: 454 - DNA, 23 bp, synthetic construct
gccaagctcggaattaaccctca

SEQ ID NO: 455 - DNA, 20 bp, synthetic construct
cgcagaccaagcaatacttt

SEQ ID NO: 456 - DNA, 20 bp, synthetic construct
gttgaattccagggtgcatt

SEQ ID NO: 457 - DNA, 24 bp, synthetic construct
cgaaaggaattcttctaaatcctc

SEQ ID NO: 458 - DNA, 765 bp, Oryza sativa
atggaggccggctacccgggcgcggcggcgaacggcgctgccgccgacgggaacggtggcgcgcagcaggcggcggccgcgccggctatacgtgagcaggaccggctgatgccgatcgcgaacgtgatccgcatcatgcgccgcgtgctcccggcgcacgccaagatctcggacgacgccaaggagacgatccaggagtgcgtgtcggagtacatcagcttcatcaccggggaggccaacgagcggtgccagcgcgagcagcgcaagaccatcaccgccgaggacgtgctctgggccatgagccgcctcggcttcgacgactacgtcgagcccctcggcgtctacctccaccgctaccgcgagttcgagggggagtcccgcggcgtcggcgtcggcgtcggcgccgcgcgcggcgaccaccaccatggtcacgtcggtgggatgctcaagtcccgcgcgcagggctccatggtgacgcaccacgacatgcagatgcacgcggccatgtacggtggcggcgcggtgccgccgccgccgcatcctcctccgcaccaccacgcgttccaccagctcatgccgccgcaccacggccagtacgcgccgccgtacgacatgtacggcggcgagcacgggatggcggcgtactacggcgggatgtacgcgcccggcagcggcggcgacgggagcggcagcagcggcagcggtggcgccggcacgccgcagaccgtcaacttcgagcaccagcatccgttcggatacaagtag

SEQ ID NO: 459 - protein, 254 aa, Oryza sativa
MEAGYPGAAANGAAADGNGGAQQAAAAPAIREQDRLMPIANVIRIMRRVLPAHAKISDDAKETIQECVSEYISFITGEANERCQREQRKTITAEDVLWAMSRLGFDDYVEPLGVYLHRYREFEGESRGVGVGVGAARGDHHHGHVGGMLKSRAQGSMVTHHDMQMHAAMYGGGAVPPPPHPPPHHHAFHQLMPPHHGQYAPPYDMYGGEHGMAAYYGGMYAPGSGGDGSGSSGSGGAGTPQTVNFEHQHPFGYK

SEQ ID NO: 460 - DNA, 1499 bp, Catalpa speciosa
gcacgaggtgctctttaaaattcacaagtacatctgacctctacatcaacacacattgactctaaattctctctctaaattctgtcaacccccaaattctagggttttgttttaattgtcatcagatttcgccttaacaggacacattggttgatttctttggagaaattaggggagcatgcaatccaagtcccagagcggcaaccaaggagaatccaacctttataatgttcctaactccaaagtaaatccggattcttggtggaataatactggatataattccttttcctcaacaatgatgggtggaaatgcatcagattcatcatccctagaacaatctgtggatggacagtcgcagtctaaaggtggtataaatgaggaagatgatgatactaccaaacgatcaccaagtagtacacctctgctgccagatagaaactataggcaggagggtccgagtctccagcaagctccacctaccatacatccaagaaacaatgggatcgttaatcaggccccacagcttgagcttggtgggcattcagtagcttgtgggtcaaatccttatgatccatattacggaggaatgatggcagcttatggccagccattggttcctcctcatttatatgatatgcatcatgcaaggatggcactgcccctggagatgactcaagagcctgtatatgtgaatgccaagcagtaccatggcattctgcggaggcggcagtctcgtgctaaagctgagcttgaaaagaagttaataaaagttcggaagccttatctccatgagtctcgacaccaacatgccttaaggagggcaagggggactggaggacgatttgcaaagaagtccgatgcagatacttccaaggggactggacccggctcatccatcccatcgcagcttattagctcatcacgaggttctgagccagtgcctgaggctcagaatttgtacaacgctgatgatggcaattttagaaggcaaaccaacttgcaggaaccggcacttcagttgggcaagacaggtgaagggcccacttcaagtcacaagtggggaaatacaacctcgaaccatgcacttgctatgcagtaaagtcatacttattggaaggtacaaatgctggttacttgtttaaatcttggctttcccaagctgagcggcaattcattcttggctgtttctattttatctcgtggaggaggaaggatgagagtctttgtttcttagcttctcttaatgtctattgttcttcccttgtgtacaaaatgtcttttagcattagaggcaaagtttgagttaggacaagacaaccgaagtttgggtagggaaaacttggtttataacttaagattcttgtaaagttccgcaaggagtcgcatgcatgtgtttgctacttacatttgttgcactttcgaattgtgaacccaaaagcatcaatggtgtttgaatagaacttttaaaagccaaaaaaaaaaaaaaaaaaaaaaaa

SEQ ID NO: 461 - protein, 307 aa, Catalpa speciosa
MQSKSQSGNQGESNLYNVPNSKVNPDSWWNNTGYNSFSSTMMGGNASDSSSLEQSVDGQSQSKGGINEEDDDTTKRSPSSTPLLPDRNYRQEGPSLQQAPPTIHPRNNGIVNQAPQLELGGHSVACGSNPYDPYYGGMMAAYGQPLVPPHLYDMHHARMALPLEMTQEPVYVNAKQYHGILRRRQSRAKAELEKKLIKVRKPYLHESRHQHALRRARGTGGRFAKKSDADTSKGTGPGSSIPSQLISSSRGSEPVPEAQNLYNADDGNFRRQTNLQEPALQLGKTGEGPTSSHKWGNTTSNHALAMQ

SEQ ID NO: 462 - DNA, 1626 bp, Zea mays
ccacgcgtccgcgatcagcgtcagttaccacgacgaccgatcttgctcgccagcgagagcgacccctcccctccctacttcccatgctgatctcggcgcgcttctcttcctcctcccccagagccgggcactgatttcccttggctgctgctgctggattctttggtgttccatcaggccaaggatcccgcaaagagctccggagccaagcctgctgcagccgtcgcgtcgggtgaggcaggcttcagcttcagtctcctactcgacgaggcaagcggatcggagcgggcctccgctccgccatgatgagcttcaagggccacgaggggtttggccaggtggccgccgccggtgccgggagccaggctgcctcccatggtggagcaggcccgctgccatggtgggcggggccccagctgctgttcggcgagccggcgcccccgtcaccggaggagacgcgccgggacgcccagttccaggtcgtgccgggggttcagggcacgccggatccagcgccgcccaagacagggacacctgaggtcctcaaattctctgtctttcaagggaatttggagtcgggtggtaaaggagagaaaaccccaaagaactctaccactattgctcttcagtcaccgttcccagaatacaatggccgtttcgagattggtcttggtcaatctatgctggccccttccaattatccttgtgctgaccagtgctatggcatgcttgcggcttatggaatgagatcgatgtctggtgggagaatgctgttgccactaaatgcgacagctgatgcacccatctatgtgaatccgaagcagtacgaaggcatcctccgccgtcgccgtgctcgcgccaaggcggagagcgagaacaggctcgccaaaggcagaaagccctatctccacgagtcgcgccacctccacgcgatgcgtcgggtaagaggcaccggcgggcgcttcgtcaacacgaagaaagaagggcgtggcacgggcgttgcttcgaacgggggcagcaagacggctgcagcggcaccgtcgcgcctcgccatgccccctagcttccagagtagcgtcgccagcctgtctggctccgacgtgtcaaacatgtacagcggcggcttggagcagcaccttcgggcgccgcacttcttcaccccgctgccacccatcatggaggacggcgaccacggtggtccccccacccgcatctcctcctccttcaagtgggcagccagcgacggctgctgcgagctcctcaaggcgtgaaccgacgaggaggaggggatggctactcagacgaacggccttctcgccgatggctggtcgtctgtaggcaaatcattcttggctgttccgcattggggtgcaacctcatccacatcatctacctacccagtaggccagtaccccctgttccctgaacagtgcttgggttacaggggtcctcctgtgtgtgtgatgatgtggtgtgcctcccccacatgcatttgctgtaacataatagtgtacccaaaccactgcttcggactatcattgtctgtctcggtatggattctctgttgtcacagtgtctgaataattgaggcgtcagacttcaaagttaaaaaaaaaaaaaaaaaaa

SEQ ID NO: 463 - protein, 322 aa, Zea mays
MMSFKGHEGFGQVAAAGAGSQAASHGGAGPLPWWAGPQLLFGEPAPPSPEETRRDAQFQVVPGVQGTPDPAPPKTGTPEVLKFSVFQGNLESGGKGEKTPKNSTTIALQSPFPEYNGRFEIGLGQSMLAPSNYPCADQCYGMLAAYGMRSMSGGRMLLPLNATADAPIYVNPKQYEGILRRRRARAKAESENRLAKGRKPYLHESRHLHAMRRVRGTGGRFVNTKKEGRGTGVASNGGSKTAAAAPSRLAMPPSFQSSVASLSGSDVSNMYSGGLEQHLRAPHFFTPLPPIMEDGDHGGPPTRISSSFKWAASDGCCELLKA

SEQ ID NO: 464 - DNA, 1569 bp, Oryza sativa
gcacgaggcgatctttccccagagagagagagagagagagagagagtcttgattgggggaggagagagggagagagagaaagagagaggacagaaaatgtttgtggatcttgagtaatgccttctaataatgataatgctgttgcaagaaatggagaatcatcctgtccaatgcatggccaagaccaactatgattttcttgccaggaataactatccaatgaaacagttagttcagaggaactctgatggtgactcgtcaccaacaaagtctggggagtctcaccaagaagcatctgcagtaagtgacagcagtctcaacggacaacacacctcaccacaatcagtgtttgtcccctcagatattaacaacaatgatagttgtggggagcgggaccatggcactaagtcggtattgtctttggggaacacagaagctgcctttcctccttcaaagttcgattacaaccagccttttgcatgtgtttcttatccatatggtactgatccatattatggtggagtattaacaggatacacttcacatgcatttgttcatcctcaaattactggtgctgcaaactctaggatgccattgcctgttgatccttctgtagaagagcccatatttgtcaatgcaaagcaatacaatgcgatccttagaagaaggcaaacgcgtgcaaaattggaggcccaaaataaggcggtgaaaggtcggaagccttacctccatgaatctcgacatcatcatgctatgaagcgagcccgtggatcaggtggtcggttccttaccaaaaaggagctgctggaacagcagcagcagcagcagcagcagaagccaccaccggcatcagctcagtctccaacaggtagagccagaacgagcggcggtgccgttgtccttggcaagaacctgtgcccagagaacagcacatcctgctcgccatcgacaccgacaggctccgagatctccagcatctcatttgggggcggcatgctggctcaccaagagcacatcagcttcgcatccgctgatcgccaccccacaatgaaccagaaccaccgtgtccccgtcatgaggtgaaaacctcgggatcgcgggacacgggcggttctggtttaccctcactggcgcactccggtgtgcccgtggcaattcatccttggcttatgaagtatctacctgataatagtctgctgtcagtttatatgcaatgcaacctctgtcagataaactcttatagtttgttttattgtaagctatgactgaacgaactgtcgagcagatggctaatttgtatgttgtgggtacagaaatcctgaagcttttgatgtacctaattgccttttgcttatactcttggtgtatacccattaccaagttgccttaaaaaccctccaattatgtaatcagtcatggttttatagaaccttgccacatgtaatcaatcacctgtttttgtaaattgatctataaacgctaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 465 - protein, 317 aa, Oryza sativa
MIMLLQEMENHPVQCMAKTNYDFLARNNYPMKQLVQRNSDGDSSPTKSGESHQEASAVSDSSLNGQHTSPQSVFVPSDINNNDSCGERDHGTKSVLSLGNTEAAFPPSKFDYNQPFACVSYPYGTDPYYGGVLTGYTSHAFVHPQITGAANSRMPLPVDPSVEEPIFVNAKQYNAILRRRQTRAKLEAQNKAVKGRKPYLHESRHHHAMKRARGSGGRFLTKKELLEQQQQQQQQKPPPASAQSPTGRARTSGGAVVLGKNLCPENSTSCSPSTPTGSEISSISFGGGMLAHQEHISFASADRHPTMNQNHRVPVMR

SEQ ID NO: 466 - DNA, 1375 bp, Glycine max
gcacgaggaggttgcagacttagaaagagagagagagagagaatgggtctcatctcaatgcaatttaggttctgaaaaccaaagcttttcataggaaaagttgtgctaagatgccagggaaacctgacactgatgattggcgtgtagagcgtggggagcagattcagtttcagtcttccatttactctcatcatcagccttggtggcgcggagtgggggaaaatgcctccaaatcatcttcagatgatcagttaaatggttcaatcgtgaatggtatcacgcggtctgagaccaatgataagtcaggcggaggtgttgccaaagaataccaaaacatcaaacatgccatgttgtcaaccccatttaccatggagaaacatcttgctccaaatccccagatggaacttgttggtcattcagttgttttaacatctccttattcagatgcacagtatggtcaaatcttgactacttacgggcaacaagttatgataaatcctcagttgtatggaatgcatcatgctagaatgcctttgccacttgaaatggaagaggagcctgtttatgtcaatgcgaagcagtatcatggtattttgaggcgaagacagtcacgtgctaaggctgagattgaaaagaaagtaatcaaaaacaggaagccatacctccatgaatcccgtcaccttcatgcaatgagaagggcaagaggcaacggtggtcgctttctcaacacaaagaagcttgaaaataacaattctaattccacttcagacaaaggcaacaatactcgtgcaaacgcctcaacaaactcgcctaacactcaacttttgttcaccaacaatttgaatctaggctcatcaaatgtttcacaagccacagttcagcacatgcacacagagcagagtttcactataggttaccataatggaaatggtcttacagcactataccgttcacaagcaaatgggaaaaaggagggaaactgctttggtaaagagagggaccctaatggggatttcaaataacacttccctcagccatacagcaagagtgaagatgaagggctttatctcatccaacttgtgatgctgtatagaaggcaattcattcttggcttagttaagtggtgagaccagtgacatggtgtacactatggccttgtttggtctctcccttgcttttgtttctctctacaagtccatatgtaaaatggataacagaaagaaaaagaaaaatcactttggtttgagaactttttaaagtttatattaactgtgttaaggttcataaaactgtagactgatttgtgtgacatgctccacagaaccttaaattttcctctattttgtcctaaaaaaaaaaaaaaaaaaaaaaaaaa

SEQ ID NO: 467 - protein, 303 aa, Glycine max
MPGKPDTDDWRVERGEQIQFQSSIYSHHQPWWRGVGENASKSSSDDQLNGSIVNGITRSETNDKSGGGVAKEYQNIKHAMLSTPFTMEKHLAPNPQMELVGHSVVLTSPYSDAQYGQILTTYGQQVMINPQLYGMHHARMPLPLEMEEEPVYVNAKQYHGILRRRQSRAKAEIEKKVIKNRKPYLHESRHLHAMRRARGNGGRFLNTKKLENNNSNSTSDKGNNTRANASTNSPNTQLLFTNNLNLGSSNVSQATVQHMHTEQSFTIGYHNGNGLTALYRSQANGKKEGNCFGKERDPNGDFK

SEQ ID NO: 468 - DNA, 1192 bp, Triticum aestivum
gcacgagggagtgacgcggtcgaggaggggcgtgcggggggcagacagagagggagcgcaaagggacggcggaggcaagctagcttcccgggggcggacgcaccgagagagggcggcgggagggaggaggcgcgtgggagccatgcttctcccctcttcttcgtcttcctcctacgatcccaaaggtgactcctttgggaaatcggttgacgatcatatgaggtcaactttgacttttggtgataagcattctgtatttgcaagtcaaaacactgactatggccacccaatggcttgcatttcatacccattcaatgattctggttctgtttgggcggcctatgggtcacgggctatgttccagcccctcatggcggaaggaggggcatctgcgaccgcaagagttccattgcctgtcgaattagcagcggatgagcccatatttgtcaatcccaaacaatataatgggattctccggcgaaggcagctgcgcgccaagttagaggcccagaataaactcacaaaaaacagaaagccctacctccacgagtctcgccatcttcacgcgatgaagcgggcaagaggttccgggggacgtttcctcaattccaaacagctgaagcagcagcagcagcagtctggcagtgcatgcacgaaggccattgcggatggcgcgaattccttgggttcaacccatctacggctaggcagcggcgcagccggagaccgaagcaactcggcgtccaaggcgatgtcctcccaagagaacagcaagagagtcgccgccccggctcccgccttcaccatgattcaagcggcgcgcaaagacgacgacttcttccaccatcacggccaccatctcagcttctccgaccacttcggccagtcgagcgaccggtatacgtaacaaggggtcctctgtgccccggtgtggtctggcaactcatccttggctttatttctggcgtgttagggtttcagagatagtgtatctcatagtactactgttgtactgctttgcacccacatagttctctgcttgatgttcggcatgcaaatgttggtgtactggtgcgttgggacaaaagtttgatgtgtttacatgacaattggtcgcggaactcatcttgtgttctgctcgactctaatgtgtgtgctcacatgtgaattccgtaaaaaaaaaaaaaaaaaa

SEQ ID NO: 469 - protein, 254 aa, Triticum aestivum
MLLPSSSSSSYDPKGDSFGKSVDDHMRSTLTFGDKHSVFASQNTDYGHPMACISYPFNDSGSVWAAYGSRAMFQPLMAEGGASATARVPLPVELAADEPIFVNPKQYNGILRRRQLRAKLEAQNKLTKNRKPYLHESRHLHAMKRARGSGGRFLNSKQLKQQQQQSGSACTKAIADGANSLGSTHLRLGSGAAGDRSNSASKAMSSQENSKRVAAPAPAFTMIQAARKDDDFFHHHGHHLSFSDHFGQSSDRYT

SEQ ID NO: 470 - protein, 298 aa, Arabidopsis thaliana; identical to SEQ ID NO: 375
  misc_feature: gi 9293997

SEQ ID NO: 471 - protein, 238 aa, Oryza sativa; identical to SEQ ID NO: 373
  misc_feature: gi 7489565

SEQ ID NO: 472 - protein, 215 aa, Vitis riparia; identical to SEQ ID NO: 372
  misc_feature: gi 7141243

SEQ ID NO: 473 - DNA, 1329 bp, Glycine max
gcacgagtagggttttctcctcccccattgacccaccgtccatcgcaaaggaagtcgcgcccaatttccatggtttgtagattaaatcttaaagcagtaagtcatcatggataaatcagagcagactcagcagcaacatcagcatgggatgggcgttgccacaggtgctagccaaatggcctattcttctcactacccgactgctcccatggtggcttctggcacgcctgctgtagctgttccttccccaactcaggctccagctgccttctctagttctgctcaccagcttgcataccagcaagcacagcatttccaccaccaacagcagcaacaccaacaacagcagcttcaaatgttctggtcaaaccaaatgcaagaaattgagcaaacaattgactttaaaaaccacagtcttcctcttgctcggataaaaaagataatgaaagctgatgaagatgtccggatgatttctgcagaagctccagtcatatttgcaaaagcatgtgaaatgttcatattagagttgacgttgagatcttggatccacacagaagagaacaagaggagaactctacaaaagaatgatatagcagctgctatttcgagaaacgatgtttttgatttcttggttgatattatcccaagagatgagttgaaagaggaaggacttggaataaccaaggctactattccattggtgaattctccagctgatatgccatattactatgtccctccacagcatcctgttgtaggacctcctgggatgatcatgggcaagcccgttggtgctgagcaagcaacgctgtattctacacagcagcctcgacctcccatggcgttcatgccatggccccatacacaaccccagcaacagcagccaccccaacatcaacaaacagactcatgatgacaatgcaattcaattaggtcggaaagtagcatgcaccttatgattattacaaatttacttaatgcctttaagtcagctgtagtttagtgttttgcattgaaaaatgccaaagattgtttgaggtttcttgcactcatttatgattgtatgagctcttatgctgagttacttttggttgtgtttatttgaggtactggtgtggtagttaaattagtttgtagctgtccataagtaaacagcgtagctgcttaattaggaggtctgaaatgatgaaatagtttgtattgttattgcagaaggtaggttttattcagtatttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 474 - protein, 268 aa, Glycine max; identical to SEQ ID NO: 132

SEQ ID NO: 475 - protein, 199 aa, Arabidopsis thaliana
  misc_feature: gi 15223482
MEQSEEGQQQQQQGVMDYVPPHAYQSGPVNAASHMAFQQAHHFHHHHQQQQQQQLQMFWANQMQEIEHTTDFKNHTLPLARIKKIMKADEDVRMISAEAPVIFAKACEMFILELTLRAWIHTEENKRRTLQKNDIAAAISRTDVFDFLVDIIPRDELKEEGLGVTKGTIPSVVGSPPYYYLQQQGMMQHWPQEQHPDES

SEQ ID NO: 476 - DNA, 1619 bp, Momordica charantia
gccaaagccttctaaaaatgtctcccactgtacaatccaatccaactccgacgccattttattccgccattgcaccacctctaatcctcgtctccgccttctaatttgccgattctcaattcctcctcctccgccggcggccgccatgagaaggtctccctctgtttctacttcctcctcctcctcctcctcctgcgtcggcggcggcggcttcgacagcaataatctcaatctcgccgcccctccgcgccggccgcaatcggagaagaccggagcgaaacgccggaagcggaatcaggacgacgccaaatgcgagattgagaatcgtaacggtaataacaacaacagcagcaacaacaatgcctcttccggccgccggagctccatttacagaggagtcactaggcaccgatggaccggccggttcgaagcgcatctctgggacaagagttcgtggaatagcattcagaacaaaaaaggaaggcaagtttatttgggagcatacgataacgaggaagctgccgcccgaacttatgacctcgctgccctcaagtactggggtcccggaaccaccctcaatttcccggtagagtcgtacaggaatgaaatagaagaaatgcggaaagttacgaaggaggagtatttggcgtcgttacggcggcggagcagcggattttcgagaggcgtatcgaagtaccgcggcgtggcccgccaccaccacaacggccggtgggaggcgcggatcggccgtgttttcggaagcaaatatctttacctgggaacttacaacacacaagaggaagcagcagcagcatatgacatggctgcaattgagtacagaggggtcaatgcagtgaccaatttcgacatcagcaattacattgggcggctggagaataaatcatcagtttttccagcagcagagcagcccctacagcccaactgctcccctgcttcctcttctgaggaaggcgaagtagtacagcagcaacagcaacagacgacgatggcgttctcaggctcgcccctccagttcccgtcgatggagaacagcccgacgacaatggaggaggatcatgatctgcattggtcattcctagacacggggttcgtgcaggtccccgacctccccctcgagaagtctggcgaattgcctgacctgttctttgatgagatcgggttcgaggacgacatcgggttgatattcgaggcgagcttggaagacgagaggtgcggggaggggggtgagaagttagaagatgtggggaaaatggagatgatgaagagtgatcatgaggagagggggttgttctcgactacttcgccatcttcgtcgtcgataaccacctcggtttcgtgtgaatttagggtttgaaaaaagggtggctttaggagatgaagtttggtgaagagtggatgagaaaaaagatcaattccagaagaatatgatcatggtttctgggtctgtggtttagtctttggttttcagtttggtttaaggaaaaagagagagaattagctgaggtgttttcttttttctttctttttttgggttttaaatttgtttttaaattatccagaaataacctttttattttctcaaaaaaaaaaaaaaaaaa

SEQ ID NO: 477 - protein, 409 aa, Momordica charantia
MRRSPSVSTSSSSSSSCVGGGGFDSNNLNLAAPPRRPQSEKTGAKRRKRNQDDAKCEIENRNGNNNNSSNNNASSGRRSSIYRGVTRHRWTGRFEAHLWDKSSWNSIQNKKGRQVYLGAYDNEEAAARTYDLAALKYWGPGTTLNFPVESYRNEIEEMRKVTKEEYLASLRRRSSGFSRGVSKYRGVARHHHNGRWEARIGRVFGSKYLYLGTYNTQEEAAAAYDMAAIEYRGVNAVTNFDISNYIGRLENKSSVFPAAEQPLQPNCSPASSSEEGEVVQQQQQQTTMAFSGSPLQFPSMENSPTTMEEDHDLHWSFLDTGFVQVPDLPLEKSGELPDLFFDEIGFEDDIGLIFEASLEDERCGEGGEKLEDVGKMEMMKSDHEERGLFSTTSPSSSSITTSVSCEFRV

SEQ ID NO: 478 - DNA, 1753 bp, Ricinus communis
gcacgagggttaccaaaaaaaacccacctctcttacattcttcaaagtcgcaaaatctttaccaaaagagagagagagagagacctaacttaaaaaaatcatactcttcttgagtactgcatttaagtttcttttgttttgtttctctcattaaaacaagaagaagaacttaagaagaagaagtaaatgaagaggtctcctacttccccgtgctcttcttcttcatcatcttcatattcatcttcttcagcttcatcttcttgtgtcggtcctgatgatactcctgtcgctcctggtagtcatcatcatcatgatcaccaccaattacgatcgcagaaatcatccaaacgcattagaaaagttaaaaaaaagcagcagaaccataatattgatcagaataatactaacaccactattactgctcctacctctgccagaagaagctccatttacagaggagtcacccggcatagatggacgggaaggtttgaggcacacctttgggataagagttcatggaataacattcaaaacaagaagggaagacaagtttatttgggggcctatgataatgaagaagcagctgctcatacttatgaccttgctgcccttaagtactggggaccagagacaaccttgaatttccccatagaaacatatcctaaagagcttgaagagatgcaaaagatgagcaaggaagagtacttggcatctcttcgacgccaaagcagtgggttttccagaggagtttctaagtaccgtggggttgctaggcatcaccacaatggtcgatgggaggcacgaatcggacgagtttttggcaacaagtatctctaccttggcacttataacacacaagaggaggcagcagcagcatatgatatggcagcaattgagtacagaggagcaaatgctgtgaccaattttgatatcagcaattacatagaccgcttgaagaagaaaggcatccttttagaccagatactccctgatcaaccacttagaaaatgctctagcgaatctgaagaagcagaagcagaagcagaagttgaacgactgccgtcactgccctcatcgatattaccacaagaacaggacacaatctcaccacaacttcaatgcacacagctccttccatccatggactcttgcacaatgattaatatggaccctatcgaagataatgagctcacctggagtttttgcttggattctgggctgacccttttctcagtacccgagctccccctcgaaaatgcttgcgagctaccggacttgttcgatgacacaggctttgaagacaatatagacttgatatttgatgggtgttgctttggaaatgatgatgacggtggtggtggtgccaaccaccaggaatttatggtggaaagtagaggatgtagggtaggggaggttgggatttcagggagcatggaggaggaaaacgggaaggagatgtgttgcagttcaagttcgccatcttgttcaacaaccacctcggtttcttcttgtaactattctgtttgaattgccgttttctttggttctggttttagctttggtcgaggtttgtttgtttgtttgtgggtagatataatatcacatgggaaatcagaggatggggaaaatgtactttttttcgaaagtaattggtgtgttgatcgccccgatatgcatatccggaacctcatctatttccaataacaaagttattatagttgatagaataaaaaaaaaaaaaaaaaaaaaaaaa

SEQ ID NO: 479 - protein, 446 aa, Ricinus communis
MKRSPTSPCSSSSSSSYSSSSASSSCVGPDDTPVAPGSHHHHDHHQLRSQKSSKRIRKVKKKQQNHNIDQNNTNTTITAPTSARRSSIYRGVTRHRWTGRFEAHLWDKSSWNNIQNKKGRQVYLGAYDNEEAAAHTYDLAALKYWGPETTLNFPIETYPKELEEMQKMSKEEYLASLRRQSSGFSRGVSKYRGVARHHHNGRWEARIGRVFGNKYLYLGTYNTQEEAAAAYDMAAIEYRGANAVTNFDISNYIDRLKKKGILLDQILPDQPLRKCSSESEEAEAEAEVERLPSLPSSILPQEQDTISPQLQCTQLLPSMDSCTMINMDPIEDNELTWSFCLDSGLTLFSVPELPLENACELPDLFDDTGFEDNIDLIFDGCCFGNDDDGGGGANHQEFMVESRGCRVGEVGISGSMEEENGKEMCCSSSSPSCSTTTSVSSCNYSV

SEQ ID NO: 480 - DNA, 1726 bp, Glycine max
ggttttggcaaaccactttaggtaaccagattactactactattgcttcatatacaaagatgctatcgtaaaaaagagagaaacttgggaagtgggaacacattcaaaatccttgtttttctttttggtctaatttttcatctcaaaacacacccattgagtatttttcatttttttgttcttttgggacaaaaaaggtgggtgttgttggcattattgaagatagaggcccccaaaatgaagaggtctccagcatcttcttgttcatcatctacttcctctgttgggtttgaagctcccattgaaaaaagaaggcctaagcatccaaggaggaataatttgaagtcacaaaaatgcaagcagaaccaaaccaccactggtggcagaagaagctctatctatagaggagttacaaggcataggtggacagggaggtttgaagctcacctatgggataagagctcttggaacaacattcagagcaagaagggtcgacaagtttatttgggggcatatgatactgaagaatctgcagcccgtacctatgaccttgcagcccttaaatactggggaaaagatgcaaccctgaatttcccgatagaaacttataccaaggagctcgaggaaatggacaaggtttcaagagaagaatatttggcttctttgcggcgccaaagcagtggcttttctagaggcctgtctaagtaccgtggggttgctaggcatcatcataatggtcgctgggaagcacgaattggaagagtatgcggaaacaagtacctctacttggggacatataaaactcaagaggaggcagcagtggcatatgacatggcagcaatagagtaccgtggagtcaatgcagtgaccaattttgacataagcaactacatggacaaaataaagaagaaaaatgaccaaacccaacaacaacaaacagaagcacaaacggaaacagttcctaactcctctgactctgaagaagtagaagtagaacaacagacaacaacaataaccacaccacccccatctgaaaatctgcacatgccaccacagcagcaccaagttcaatacaccccccatgtctctccaagggaagaagaatcatcatcactgatcacaattatggaccatgtgcttgagcaggatctgccatggagcttcatgtacactggcttgtctcagtttcaagatccaaacttggctttctgcaaaggtgatgatgacttggtgggcatgtttgatagtgcagggtttgaggaagacattgattttctgttcagcactcaacctggtgatgagactgagagtgatgtcaacaatatgagcgcagttttggatagtgttgagtgtggagacacaaatggggctggtggaagcatgatgcatgtggataacaagcagaagatagtatcatttgcttcttcaccatcatctacaactacagtttcttgtgactatgctctagatctatgatctcttcagaagggtgatggatgacctacatggaatggaaccttgtgtagattattattgggtttgttatgcatgttgttggggtttgttgtgataggttggtggatgggtgtgacttgtgaaaatgttcattggttttaggattttcctttcatccatactccgttatcgaaagaagaaaatgttcattttagacttggattttagtataaaaaaaaaggagaaaaaaccaaaaatgtgatttgggtgc

SEQ ID NO: 481 - protein, 412 aa, Glycine max
MKRSPASSCSSSTSSVGFEAPIEKRRPKHPRRNNLKSQKCKQNQTTTGGRRSSIYRGVTRHRWTGRFEAHLWDKSSWNNIQSKKGRQVYLGAYDTEESAARTYDLAALKYWGKDATLNFPIETYTKELEEMDKVSREEYLASLRRQSSGFSRGLSKYRGVARHHHNGRWEARIGRVCGNKYLYLGTYKTQEEAAVAYDMAAIEYRGVNAVTNFDISNYMDKIKKKNDQTQQQQTEAQTETVPNSSDSEEVEVEQQTTTITTPPPSENLHMPPQQHQVQYTPHVSPREEESSSLITIMDHVLEQDLPWSFMYTGLSQFQDPNLAFCKGDDDLVGMFDSAGFEEDIDFLFSTQPGDETESDVNNMSAVLDSVECGDTNGAGGSMMHVDNKQKIVSFASSPSSTTTVSCDYALDL

SEQ ID NO: 482 - DNA, 1878 bp, Glycine max
aaaccagcaaccccaccttgcatgcattcaagtacttcttctttgtaaccaaattaaaacctcttgatttattgtttcatttaatcaaatagtagtaataatatcaccaccgcaccgacatggagaagaagtagctcttcattcaaagagtaacgcctctccagagactagtacttcattttgcaccattgatatctcaaatggctcgtgcttcgaccaactggctatcgttctctctctcccccatggatatgctccgaacccccgaacctcagttcgttcaatacgacgccgcttccgacacttcctcgcatcactactacctcgacaacttgtacaccaacgggtgggggaacgggagcctcaagtttgagcagaatctgaaccacagcgacgtgagtttcgttcaatcgtcgtcgcagagcgtcagccacgcgccgccgaagctggaggattttctcggcgactcctccgctgttatgcgttactccgacagccagacggagacgcaggactcgtcgctgacgcacatctacgaccaccaccaccaccaccaccacggttcttctgcgtacttcggcggtgaccaccaggatctcaaggccattactggattccaagctttttcgactaactctggctccgaggttgatgattctgcatcgatcggaaaggcgcagggcagcgagttcgggactcactctattgagtcctccgtcaacgagttcgccgcgttctccggtggcaccaacaccggtggaaccttgtcgctcgccgtcgcgcagagctccgagaaggccgtcgctgctgcggcggagtccgatcgctcgaagaaggttgtggataccttcggccagcggacttctatatacagaggtgtcactaggcaccgatggacaggaagatatgaagcgcatctatgggacaatagttgcagaagggagggtcaagctagaaaagggcgtcaagtttatttgggtggatatgataaggaagaaaaggccgctagatcttatgatttggcagctctgaagtactggggtcccactgctaccaccaacttccctgtttccaattattcaaaggaagtggaggagatgaaacatgtaacaaagcaggaatttatcgcatcattgcgaaggaaaagtagtggtttctccaggggagcttccatatacagaggtgttacaaggcatcatcaacagggtaggtggcaagcaagaattggccgtgtagctggaaacaaagatctttacttgggaacattcgcaaccgaggaggaagcagcagaggcatatgatattgcagccattaagttcagaggtgcaaacgcagtaaccaactttgagatgaatagatatgatgtggaagctataatgaagagttctcttccagtgggtggggcagcaaagcgcttgaagctttcccttgaatcagagcagaaagctcttcctgtgagcagcagcagcagcagcagtcagcagcagaatccacagtgtggaaacgtgagtgccagcatcaatttctcatccattcatcagccaattgcttctatcccttgtggaattccctttgattcaacaacagcatattatcatcacaaccttttccaacattttcaccctaccaacgctggcacagcagcgtctgctgttacttctgccaatgcaaatgcactaactgcactgccaccaacagcagcagctgagttctttatttggcctcatcagtcttattgatctaatcaaaactagaaatcatcttttgctaatttcctggttatgctaacaaatcaaaagctatagtctctggcacagtttagctgacccccctcctctattattaacccctttaggctgctaaaaaaaaaaaaaaaaa

SEQ ID NO: 483 - protein, 512 aa, Glycine max
MARASTNWLSFSLSPMDMLRTPEPQFVQYDAASDTSSHHYYLDNLYTNGWGNGSLKFEQNLNHSDVSFVQSSSQSVSHAPPKLEDFLGDSSAVMRYSDSQTETQDSSLTHIYDHHHHHHHGSSAYFGGDHQDLKAITGFQAFSTNSGSEVDDSASIGKAQGSEFGTHSIESSVNEFAAFSGGTNTGGTLSLAVAQSSEKAVAAAAESDRSKKVVDTFGQRTSIYRGVTRHRWTGRYEAHLWDNSCRREGQARKGRQVYLGGYDKEEKAARSYDLAALKYWGPTATTNFPVSNYSKEVEEMKHVTKQEFIASLRRKSSGFSRGASIYRGVTRHHQQGRWQARIGRVAGNKDLYLGTFATEEEAAEAYDIAAIKFRGANAVTNFEMNRYDVEAIMKSSLPVGGAAKRLKLSLESEQKALPVSSSSSSSQQQNPQCGNVSASINFSSIHQPIASIPCGIPFDSTTAYYHHNLFQHFHPTNAGTAASAVTSANANALTALPPTAAAEFFIWPHQSY

SEQ ID NO: 484 - DNA, 1959 bp, Catalpa sp.
gcacactacacgcactaactgagagtcttgcgctgtttcccaaagaacccttctctatcctctgtctaattttcacgctcaccaacgataatggatatggattcttctcatcagaactggctcgccttctcgctttccaaccactctctgtttcacccctcgttcaactctaatccctcctccagctgcggggttgtgaatcaagaaaatggcggtgcgggtggtgccgcaacagatcatcatctctcggttcttgccagtggagggccaaagctggaggattttctgggcgcctcctgtggttcttccggcggacatacgactcagtacgacggcggagctcagggagttaatatatcagatgtagagatatatggtgactcggagctgaagacaatagctgctagtttcttacgcgggttgtcgcatgaacgaagtgatgactcccagaagcagactgctgtggcagcgcctcctgagccgccggcgaagaaggctgcagaaacatttggccaacgtacctcgatttttcgaggagttactagacataggtggactggaagatatgaagctcatttgtgggacaatagttgcagaagagaaggacaaagccggaaaggaagacaagtttatttaggtggatatgataaagaagagaaagcagctagggcttatgatcttgctgctctcaagtattggggtccgaccaccaccaccaattttccggtatcagattatgagagggaaatggaggagatgaagcatatgacaagacaagaatttgttgcttcacttagaagaaaaagcagcggcttttcaaggggggcctccatttacagaggagtcacaaggcaccaccagcacggccggtggcaagcaagaattgggagagttgccggaaataaagatctatatcttggcaccttcagcacgcaagaggaggcggccgaggcttacgacattgccgcaataaaattccgcggtcttaacgccgtgacgaacttcgacatgagtcgatatgacgtgaggagcattgctagctccaatctaccgattggaggcgcgaacaacaaatcaatgacctcatctgaatcagtatccgagaataagagtaccgatgatattaacaaggacctctcctcctcctcggtctcgttcccatccccaaattctgccgcagcaataaacttcgctctccccataaaacaagaccactccacaagcttgtggaatgctttagggtaccagaactccaccatcacaaacaacaccagaaaccctaacaccagcgtttctcttttccacgactccaacttcagcatggagtttcaggccaataacaacgagggcttcttcaatggctgcggttactttcagcatcaagaaaacggcacgaatacttcatcaacttcaactccaccttctcttgcttctcccaataatggtgcagtaactgacgatctgggcaatgggagctggatgacgccattgggagctggatgacgccatcgggtcattcttaccaagctgcaaaatccagtttgtcatcttttcagacaccaatttttggaatagaatgaggagggaagaaaagtgtgaatgatgttcatgttgtttagttggaatacaagtagaggtgggttggtcaaaaagaggagaggatgctttttgcatggattagaaatgaaatgggattgacaatcatttcacagcaactatgtgcctgtagtatagtactgtaaactgaatctttttggttatgaggctgtggtggttcccgttttccttaccttttttttgtccttttgttcacatgtttatagagattaattaaagaattatctattgtattatggataatttccatctaattaagcttataagagatatatagtattgatgcccaaaaaaaaaaaaaaaaaaaaaaaaaaaaaaaaaaaaaaaaaaaaaaaaaaaaaa

SEQ ID NO: 485 - protein, 470 aa, Catalpa sp.
MDMDSSHQNWLAFSLSNHSLFHPSFNSNPSSSCGVVNQENGGAGGAATDHHLSVLASGGPKLEDFLGASCGSSGGHTTQYDGGAQGVNISDVEIYGDSELKTIAASFLRGLSHERSDDSQKQTAVAAPPEPPAKKAAETFGQRTSIFRGVTRHRWTGRYEAHLWDNSCRREGQSRKGRQVYLGGYDKEEKAARAYDLAALKYWGPTTTTNFPVSDYEREMEEMKHMTRQEFVASLRRKSSGFSRGASIYRGVTRHHQHGRWQARIGRVAGNKDLYLGTFSTQEEAAEAYDIAAIKFRGLNAVTNFDMSRYDVRSIASSNLPIGGANNKSMTSSESVSENKSTDDINKDLSSSSVSFPSPNSAAAINFALPIKQDHSTSLWNALGYQNSTITNNTRNPNTSVSLFHDSNFSMEFQANNNEGFFNGCGYFQHQENGTNTSSTSTPPSLASPNNGAVTDDLGNGSWMTPLGAG

SEQ ID NO: 486 - DNA, 1935 bp, Gossypium hirsutum
gggattcttcttccggtcccaacaattcccttgctttctctctttccagccatcactaccaccaaaatcatctcagcttcttctcttcttcttctaaccccactctctttcaagctttcaacacttccgcagccgccgccgtcccaacaacaacaccacccgcaaactcgttatcagccgaaaaagatgcaggtggcgaaggtccagctacaaccgctagtgcaacaacagacttgtccatgtttaaaggtggcccgaaactcgaggattttcttggcggttcttctactacacctggagttggaggtgcacctcaactgcagttgcttcatcatcataacttctctactcaaacacccgtgactgtttctgacaacgatatatatgattcggagctcaaaaccattgctgctatatttcttcgtggattttcctctgagcaaatcgatattcacaaacaacagcaacaagcacctatagctgagcctgcacccaaaagatctgttgatacttttggccaacgtacctcgatctaccggggtgtcaccaggcatagatggactggaaggtatgaagctcacttgtgggacaatagttgcagaagagaaggccaaagtaggaaaggaaggcaagtttatttgggtggctatgacaaggaagataaagctgcaagagcttatgatcttgcggctctcaagtactggggtccgaccactactaccaactttccgatttccaactatgagaaggagctcgaagagatgaagaacatgactaggcaagagttcgttgcttctctccggaggaaaagtagtggattttctaggggtgcttcaatttacagaggagtgacaaggcatcatcaacatggtaggtggcaagcaagaattggaagagttgcaggcaacaaagatctctatcttggcacatttagcacccaagaagaagcagctgaagcctatgatattgcagcaatcaagtttagaggcttaaacgcggttacaaattttgatatgagccgctacgatgtaaacagcattgcaaacagcaatcttcccattggaggactgaacaacaaatccaaaaactgcaatgattcaacttctgataggagcaccgatgaggagcgagatcactctggatcatcgggcatgacctttacatctcagcccgctgcaagctccacagtaggctttgcaattaacatcaagcaagacccatccgattattggtcaaacgttctcggatacaatgatactggtgcttccttaagcagtgccaagaaccctatatttcatcactcaccaaatggatccggtttccaaagtccaagtggattctgtaccggcaatggtgggaattctgcagtcaacggaagcattaacaatgggttattcaatcgaggtggttatgttgggcaggagcaacaagagagcagtgctgctactaattcccacccattggcaacgccaattgtcttaaataatagcgataattatgagagctcgtcttctggctatggtggtaactggaatctcgcacagtcgtttcaatctacttatcaaactgcaaagccaagtctctcagtgttccaaacaccaatttttggcatggaatgaaatcagcttcacatggacaataactgtggaaaaaatctgtgggaaggccgatgcattgcagagttggaagggggtagggttgttaacctttcttgaataggtgagattggaatgacagatcatttcataggagctgacagggccaactcaagttcttttgttaattaagggcgttcggttccatttctttcgtttcttttagcttttatccttcactgacatgagtaaaatatatatatgtattatgtaatgtgtgggtataaccgtaaaacgaaaatggaaatcctttcctctaaaaaaaaaaaaaaaaaaaaaa

SEQ ID NO: 487 - protein, 538 aa, Gossypium hirsutum
DSSSGPNNSLAFSLSSHHYHQNHLSFFSSSSNPTLFQAFNTSAAAAVPTTTPPANSLSAEKDAGGEGPATTASATTDLSMFKGGPKLEDFLGGSSTTPGVGGAPQLQLLHHHNFSTQTPVTVSDNDIYDSELKTIAAIFLRGFSSEQIDIHKQQQQAPIAEPAPKRSVDTFGQRTSIYRGVTRHRWTGRYEAHLWDNSCRREGQSRKGRQVYLGGYDKEDKAARAYDLAALKYWGPTTTTNFPISNYEKELEEMKNMTRQEFVASLRRKSSGFSRGASIYRGVTRHHQHGRWQARIGRVAGNKDLYLGTFSTQEEAAEAYDIAAIKFRGLNAVTNFDMSRYDVNSIANSNLPIGGLNNKSKNCNDSTSDRSTDEERDHSGSSGMTFTSQPAASSTVGFAINIKQDPSDYWSNVLGYNDTGASLSSAKNPIFHHSPNGSGFQSPSGFCTGNGGNSAVNGSINNGLFNRGGYVGQEQQESSAATNSHPLATPIVLNNSDNYESSSSGYGGNWNLAQSFQSTYQTAKPSLSVFQTPIFGME

SEQ ID NO: 488 - DNA, 2374 bp, Zea mays
gaaatcctcgcccccttgtactgctcgccacagcgcggaatctcacctctcttccccgacccgagagagctcggtcggacaaacccaccacccacaccggccggccgggagagccacgaagttactgcgcgcgtacgtcgccggtttcctttctcaccgcacgtcgtcgtcatggacacctcgcaccactatcatccatggctcaacttctccctcgcccaccactgtgacctcgaggaggaggagaggggcgcggccgccgagctggccgcgatagccggcgccgcgccgccgccgaagctggaggacttcctcggcggaggcgtcgccaccggtggtccggaggcggtggcgcccgcggagatgtacgactcggacctcaagttcatagccgccgccgggttccttggcggctcggcggcggcggcggcgacgtcgccgctgtcctccctcgaccaggccggttccaagctggccttgcctgcggcggcggctgctccggcgccggagcagaggaaggccgtcgactcctttgggcagcgcacgtccatctaccgcggcgtcacacggcaccggtggactggcaggtacgaggcacatctgtgggacaacagctgccgacgcgaagggcagagccgcaagggccgccaagtatatttgggtggctatgataaggaggagaaggctgccagggcgtatgatcttgcagctttgaagtactggggttctagcaccaccaccaactttccggttgctgagtatgagaaggaggtcgaggagatgaagaacatgacgcgacaagagtttgttgcttcccttcgaaggaagagcagtggattctctcggggtgcttccatctaccgaggtgtaaccagacatcaccagcatggacggtggcaggcgaggatcggaagggtggccggtaacaaggacctctaccttgggacgttcagcaccgaggaggaagctgcagaggcctacgacatagcggccatcaagttcagaggcctgaacgccgtcacaaacttcgagatcagccggtacaacgtggagaccataatgagcagcaaccttccagtcgcgagcatgtcgtcgtcggcggcggcggcggcgggtggccggagcagcaaggcgctggagtcccctccgtccggctcgcttgacggcggcggcggcatgccagtcgtcgaagccagcacggcaccgccgctgttcattccggtgaagtacgaccagcagcagcaggagtacctgtcgatgctcgcgttgcagcagcaccaccagcagcaacaagcagggaacctgttgcaggggccgctagtagggttcggcggcctctactcctccggggtgaacctggatttcgccaactcccacggcacggcggctccgtcgtcgatggcccaccactgctacgccaatggcaccgcctccgcctcgcatgagcaccagcaccagatgcagcagggcggcgagaacgagacgcagccgcagccgcagcagagctccagcagctgctcctccctgccattcgccaccccggtcgctttcaatgggtcctatgaaagctccatcacggcggcaggcccctttggatactcctacccaaatgtggcagcctttcagacgccgatctatggaatggaatgattcgggccgcccggtcgtggctgctggtcggcctccgctcgccgctggcgtctcgcatgtgcgaaaagggtggggagaagccatgagaacacgagactgacatgggcgctctcgcacaaaagacataaagcggggggactgaaagatcagaggtaccagtagacagtagtagtatgatggaagagacagtaagcagcgagtagtgtgctgcaggatacactgaccatcgatctgctaacaacaaaatgatcgttgcagctagctatagcatatttgcctttgcccttttgtagctttggtctggtctctctctctctctctctcttttttcagctttgttgctccccagcgtcctgcactgcatgccagctgctttgaagctttctctttctactgacatggttctgcaagtgccatcatagctttagtcagccctgtacaatggatgcaggaacgtcgtctttgaattggatctctgtagctcatctctccccctagctcccccactttgttttcttttttgtgctttcctttctgctgcctctgctagcgttatgtgtactgaacaagttcatcaaacagatatagcacccttgcaactatgaatcaatgtcggtcttatttaatgaaactctcccaaatttaccgccttaaaaaaaaaaaaaaaaaaaaaaaaaaaaaaaaaaaaaaaaaaaaaaaaaaaaaaaaaaaaaaaaaaaaaaaa

SEQ ID NO: 489 - protein, 492 aa, Zea mays
MDTSHHYHPWLNFSLAHHCDLEEEERGAAAELAAIAGAAPPPKLEDFLGGGVATGGPEAVAPAEMYDSDLKFIAAAGFLGGSAAAAATSPLSSLDQAGSKLALPAAAAAPAPEQRKAVDSFGQRTSIYRGVTRHRWTGRYEAHLWDNSCRREGQSRKGRQVYLGGYDKEEKAARAYDLAALKYWGSSTTTNFPVAEYEKEVEEMKNMTRQEFVASLRRKSSGFSRGASIYRGVTRHHQHGRWQARIGRVAGNKDLYLGTFSTEEEAAEAYDIAAIKFRGLNAVTNFEISRYNVETIMSSNLPVASMSSSAAAAAGGRSSKALESPPSGSLDGGGGMPVVEASTAPPLFIPVKYDQQQQEYLSMLALQQHHQQQQAGNLLQGPLVGFGGLYSSGVNLDFANSHGTAAPSSMAHHCYANGTASASHEHQHQMQQGGENETQPQPQQSSSSCSSLPFATPVAFNGSYESSITAAGPFGYSYPNVAAFQTPIYGME

SEQ ID NO: 490 - DNA, 1954 bp, Glycine max
  Unsure (59): n = A, C, G, or T
  Unsure (313): n = A, C, G, or T
cacgaggcctsgtgccatctgcggggkgtaagtttgtgggattttttttgtgagaaaanagaaaccgtttgtgtctgtgtgtgtttgtgaaatagtgtgttaatataagtactggtggggtctctctcactccacgcttgaggattgatgaagagtttgagagagaaaccaagagcgtggaggagggtaccatcatctctctctgtcaccctcacttgtctgttatgccccttcgctctgatggctctctctgtgttgctgactcctttagtcactctgctgcatctcaagaatggagatatgatagtgcaantaggtggagggaattccaatgaagaaggtccaaagcttgaagactttttgggttgctactcagactcccccgctaaggtcttttgccaagactctcagcctgaccaaaaccaaagccagaacaatgtttccaaaatcaatgttaatgtggcaccaagcttttgcaccaacgattcagagattgaaactggggataatctcacaaatccttcttccttgctccattctttccatgcatataatgataactcacatgctcttatccccaccaatggcatgtacaagtcctggttggcacagacccagttttcttctgatggaaaaccttcaaatgaggctaatgggtgcaatttccaatctttgtccctcactatgagccccagtgtgcaaaatggggtgggtgcaatttcctctgttcaagtgaatgaggatagtaggaaacgggtcatggcgaaatctcatgctagagaaccagttcctcgcaaatctattgacacttttgggcaaagaacatctcaatatcgtggtgttacaaggcatagatggactggaagatatgaggcccatttgtgggataatagttgcagaaaggaagggcaaacaaggaaaggaaggcaagtttaccttggtggttatgataaggaagaaaaagcagcaaaggcttacgacttagctgcactcaagtattggggtccaacaactcacataaatttccctttaagcacttatgagaaggaacttgaagagatgaagcacatgaccaggcaagaatttgtcgccaatttaagaaggaagagcagtggattttcaagaggggcatctgtgtatagaggtgtgacaagacaccatcaacatggaaggtggcaggcccgaataggaagggttgcaggaaacaaggacttgtatcttggtacatttagcacacaagaagaagctgctgaagcatatgatatagcagcaatcaagttcagaggaacaagtgctgtgaccaactttgacataagtaggtatgatgtgaagagaatctgctcaagctccactcttattgcaggagatcttgcaaaacggtctcctaaagaatcaccagctccggttcctgcctctgacttcaattcgtgcggttcatcgccgatgccgctggtgtctcagccacctcctttggctataactgatggtgaacattctgatgagttgtccaacatgatgtggaatgccaacaacagtgatgagcaagcacagaatgagagtggtggtgctgaattcaacaacaatgtaactgaatcatcatcatcacaacaggtttcaccaagcagcaacaaggatgctttgaaccctcaaagccccaatgagtttggagtcagtggagcagattatggacatggctacttcacccttgatggaccaaaatatgatgatgggaacaatgaaaatgaccacatgagcaccaacaggcttggaaatttgggattggttaatcaagttcccatgtttgctttgtggaatgaatgaagggaatgttatgttgatgagttgagattacaaaaaacattagcttaggaaaaaaaactaagatcagatggcagaattattgaatgattattatattgtagcttggtatggtaactttttattttatgttgaa

SEQ ID NO: 491 - protein, 557 aa, Glycine max
  UNSURE (56): Xaa = any amino acid
MKSLREKPRAWRRVPSSLSVTLTCLLCPFALMALSVLLTPLVTLLHLKNGDMIVQXGGGNSNEEGPKLEDFLGCYSDSPAKVFCQDSQPDQNQSQNNVSKINVNVAPSFCTNDSEIETGDNLTNPSSLLHSFHAYNDNSHALIPTNGMYKSWLAQTQFSSDGKPSNEANGCNFQSLSLTMSPSVQNGVGAISSVQVNEDSRKRVMAKSHAREPVPRKSIDTFGQRTSQYRGVTRHRWTGRYEAHLWDNSCRKEGQTRKGRQVYLGGYDKEEKAAKAYDLAALKYWGPTTHINFPLSTYEKELEEMKHMTRQEFVANLRRKSSGFSRGASVYRGVTRHHQHGRWQARIGRVAGNKDLYLGTFSTQEEAAEAYDIAAIKFRGTSAVTNFDISRYDVKRICSSSTLIAGDLAKRSPKESPAPVPASDFNSCGSSPMPLVSQPPPLAITDGEHSDELSNMMWNANNSDEQAQNESGGAEFNNNVTESSSSQQVSPSSNKDALNPQSPNEFGVSGADYGHGYFTLDGPKYDDGNNENDHMSTNRLGNLGLVNQVPMFALWNE

SEQ ID NO: 492 - DNA, 1333 bp, Glycine max
gcacgagattgagtttttggcttctcacttctttttttctttcacactctcaacgaagtgatttataacagtgtttaattgaaattccaaacatggattgggttcgaggagacgctgtcggacgaggaagctttgctaccgttagtttagctattccaacgacgaattacaatcagtttccgtctctaaccgtggttaagtccgctgacgctcaaacctcgtgctggctcagaaacgagaaacacgtgctggatcgcctaggttcgtgtccgaggataattcgctgcttcggagatgactgcagtttcgagaacggcgtcgagtactacaatttgttcctcgaatacgccgccggcgggagtctcgccgacgaattgaggaaccacgatggcaggattcccgagcctcaggctcgggaatacacgagggacatcgtggagggtttgagccacgtgcacaaaaacgggtttgttcactgcgatataaagctgcagaacatcctcgtattcgaggacggaaggattaaaattgcggatttcggcctcgcgagggaggcaggggagagacaggggaagaagagtgaatgcagggggactccgatgtttatgtcgccggagcaagtgaccggcggcgagtgtgaatcgcccgcggatatatgggctttgggatgtgcagttgtggagatggtgaccgggaaaccggcgtggcaggtggagaatgggtcgagcatgtggtcgctgttgcttcgaattggggtgggacaagaggttcccgagatccctaataatttgtccgaagatggaaaagatttcattgaaaaatgtttcattaaggatcctaagaagaggtggagcgcagaaatgctattgaaacacccttttctactcaacgatgacactgtttcatttaagcgcgttcatgagtcgcccagaagccactttgatttccccgattgggtttctagcgtggcgaattcgcttcccagttcgccggaatttcaagaaaagtggggttttgatgatgagttctgttcgccggaggaccggctccggcagcttttgactgttaatcggccggcgagttggtcggaatcagatgggtggagtagtgttaggtgaaattgggggttttcaagattgttcaacgaaatggttcgattttgattatattcagattctttgatttttaattgttgtaaattgggtaggatatacatacatacacattacattcatgatttgtgaactgactttgatggaagagttttaacttgtgccggttgtggcccgttgtacagaggctcattctgccgtataaaaaaaaaaaaaaaaaa

SEQ ID NO: 493 - protein, 341 aa, Glycine max
MDWVRGDAVGRGSFATVSLAIPTTNYNQFPSLTVVKSADAQTSCWLRNEKHVLDRLGSCPRIIRCFGDDCSFENGVEYYNLFLEYAAGGSLADELRNHDGRIPEPQAREYTRDIVEGLSHVHKNGFVHCDIKLQNILVFEDGRIKIADFGLAREAGERQGKKSECRGTPMFMSPEQVTGGECESPADIWALGCAVVEMVTGKPAWQVENGSSMWSLLLRIGVGQEVPEIPNNLSEDGKDFIEKCFIKDPKKRWSAEMLLKHPFLLNDDTVSFKRVHESPRSHFDFPDWVSSVANSLPSSPEFQEKWGFDDEFCSPEDRLRQLLTVNRPASWSESDGWSSVR

SEQ ID NO: 494 - DNA, 1261 bp, Oryza sativa
gcacgagcttacatatagctaagccccccaagagacatcgagagcgagatcgccatggccgccgccgccgccgcggcggaggcggcgatgctgaggagggagcgggggatgatgtctgggctgtcctcgccacacgtcgtgccctgcatcggcggcggcgatggccccgacgggtcatacaatctcttccttgagttcgcccccgggggatcgctcgccaacgaggttgccagggatgggggacgcctcgaggagcgcgcgatcagggtgtacgcggcggatgtcctgcgcgggctgacgtacctccacgggatgtcgctcgtacacggggatgtcaaggcggacaacatagtgatcggtgtcgacgggctcgccaagctcgccgacttcgggtgtgcgaaaaccatggattcggagcggccggtcagcggcacacctgcgttcatggcgccggaggttgcccgcggggaggagcaggggccagcggcagacgtttgggctcttggctgcacggtcatcgagatggccaccgggcgcgcgccgtggagcgacatggacgacgtcctcgccgccgtccaccggattgggtacacggacgccgtgccggaggtgccggtttggctgtccgcagaggcgaaggacttcttggccatgtgttttgcgagaaacgccggcgaccggagcaccgcggcacagctcttggagcatccgttcgtggcattcgcctgccacgaagtcaaggccgcgcagccgaagcccaggtgggtctctccgaagagcacactggacgccgcattctgggagtcggagaccgacgacgaggaggaggtcgacgagataacagagagcctctgcgataggatcaagtcattggcgtgccctgtttcggccttgccggattgggactccgacgaaggctggatcgatctgctcggcgagcagtgcgaggcttgcgattcggaagcggccagggaatcgattgatgtggcgcgtagcgcgccaagcaaagtgtccagcgcggcgacggtgccagctgctgaagtggtgcttgtcggcggcggctgctgtccaagcaatgaagcggacgctttcgatcagtcaattggtggcgatatccaagccgctgatcgttcaatcgagcgtcggaataaagtctgcgctggttcagacaatgatgtacttccatttcgattagtatgtaacggaatttgtgcaatggaattctttcagtttttcccaaaaaaaaaaaaaaaaaaaaaaa

SEQ ID NO: 495 - protein, 394 aa, Oryza sativa
MAAAAAAAEAAMLRRERGMMSGLSSPHVVPCIGGGDGPDGSYNLFLEFAPGGSLANEVARDGGRLEERAIRVYAADVLRGLTYLHGMSLVHGDVKADNIVIGVDGLAKLADFGCAKTMDSERPVSGTPAFMAPEVARGEEQGPAADVWALGCTVIEMATGRAPWSDMDDVLAAVHRIGYTDAVPEVPVWLSAEAKDFLAMCFARNAGDRSTAAQLLEHPFVAFACHEVKAAQPKPRWVSPKSTLDAAFWESETDDEEEVDEITESLCDRIKSLACPVSALPDWDSDEGWIDLLGEQCEACDSEAARESIDVARSAPSKVSSAATVPAAEVVLVGGGCCPSNEADAFDQSIGGDIQAADRSIERRNKVCAGSDNDVLPFRLVCNGICAMEFFQFF

SEQ ID NO: 496 - DNA, 1348 bp, Oryza sativa
aaaaagaagaaacaaagagagaagaattccaaggaccaagaaatcgaggcaatggctaagcagctcaggcgggtgcgcacgctgggccgcggggcgtccggcgccgtggtgtggctcgcgtccgacgacgactcaggggagctcatggccgtcaagtcggcctccgccggcggcgccgcggcgcagctgcggcgagaggggcgtgtcctgtccgggctctgctcgccgcacatcgtcccctgcctcggatcgcgcgccgccgcgggcggcgagtaccagctgttcctcgagttcgcgcccggcgggtcgctcgccgacgaggccgccaggaacgggggctgcctcccggagccggccatccgggcgtacgccgctgacgtggcgagggggctggcgtacctccacgggaattcgctggtgcacggcgacgtcaaggcgaggaacgtcgtgatcgggagcgacggccgggcgaggctcacggacttcgggtgcgcgagggtcatggactcggcggggccgatcggcggcacgccggcgttcatggcgccggaggtggcgcgcggggaggagcaggggccggcggccgatgtctgggccctcggctgcaccatcatcgagatggccaccggccgcgcgccgtggagcgacatggacgacatccttgccgcagtccaccggatcgggtacacgaacgccgtgccggaggttcccgggtggctgtcagcggaggccaaggacttcctggatggctgcttcgagaggaacgcgtccgacaggtcaacggcggcgcagctcctggaacacccattcgttgcctccgccgcggccctcgaccgctggccggagccggcgaagcaagaacgtgcatcccccaagagcacgctgcatgacgcgttctgggactcagacaccgacgacgaggacgacgagatgccaaccggcgcggcggagaggatcggtgcattggcgtgcgccgcctcggccttgccggactgggactccgacgaaggatggatcgaggtgcacgacgaggtctccttcgccgccgtcacgccgccggccagcgacgcggactacttcgtctgggcagaactgtctgacccagagatggagcagttcgccgtcgccgcggatggcgtcaaccatgtcccgcgcaatgaagcagaagcgatcgaatcctccattaggcagggcagttacctgcacgtacatcttggcagtggtaaaaatgaaatttttcacccgttcgatactgacgggactgaatcagtgagattcgattgtgtttgtaacaggaacagagtaataaaattaaattccgctcaaaaaaaaaaaaaaaaaaaaaaaa

SEQ ID NO: 497 - protein, 424 aa, Oryza sativa
MAKQLRRVRTLGRGASGAVVWLASDDDSGELMAVKSASAGGAAAQLRREGRVLSGLCSPHIVPCLGSRAAAGGEYQLFLEFAPGGSLADEAARNGGCLPEPAIRAYAADVARGLAYLHGNSLVHGDVKARNVVIGSDGRARLTDFGCARVMDSAGPIGGTPAFMAPEVARGEEQGPAADVWALGCTIIEMATGRAPWSDMDDILAAVHRIGYTNAVPEVPGWLSAEAKDFLDGCFERNASDRSTAAQLLEHPFVASAAALDRWPEPAKQERASPKSTLHDAFWDSDTDDEDDEMPTGAAERIGALACAASALPDWDSDEGWIEVHDEVSFAAVTPPASDADYFVWAELSDPEMEQFAVAADGVNHVPRNEAEAIESSIRQGSYLHVHLGSGKNEIFHPFDTDGTESVRFDCVCNRNRVIKLNSA

SEQ ID NO: 498 - DNA, 983 bp, Zea mays
tttttgcctatacttgaaaccctaactctgcttttgctgcaacccctgcctcaaaaattcacttgtcgctactgactctgacacaccacaccgctttgaggggggcttgcacccaggaaaaaaagcagggggggctcggtagctgctattcttccccaagaccttaacaactagcttctgtttctacgatccttctctcctcctctcgtccttcgtcgtcgtcgtcgtcgtcgcgtgatctcggcctcctgcgacctccatggctggcaaagctgctgcagacactgggagcaacgaccgagtcgttgaggttgaggggtcctcctcctcctccatggcggacgtgtacaaaggcgagctcacgccgctgcagaggcacgtctccttcttcgaccgcaacaaggacggcgtcatctacccctccgagacataccaagggttccgagctatcgggtgtggcgtcgccctgtctgctgctgctgccgtcttcgtcaacggtggacttggacccaagaccgtactggagaacgagaagcctgcgcctttcaagttccccatctacgtgaagaacatccacaggggcaagcacggcagcgattcgggcgtctacgattccaacggaagatttgttcctgaaaagtttgaggagattttcaagaagtatgcccaaacgaggcctgatgcccttacaggcaaagagctacaggagatgatgaaagcaaacagagaacccaaggacttgaaaggatggctgggtggcttcacagagtggaaggtgctgtactccctgtgcaaagacaaggacgggtttctccacaaagacactgtcagggcggtctaccatggcagcctgtttgaaaggttggggcaagagaggaactcaaagaaagagtcgagtaagaagaaatgatgagaaatccaaacgctcttatgtgggacgagtttgcaagtcacgcctgtgcgtgtgggtgggtactatcata

SEQ ID NO: 499 - protein, 216 aa, Zea mays
MAGKAAADTGSNDRVVEVEGSSSSSMADVYKGELTPLQRHVSFFDRNKDGVIYPSETYQGFRAIGCGVALSAAAAVFVNGGLGPKTVLENEKPAPFKFPIYVKNIHRGKHGSDSGVYDSNGRFVPEKFEEIFKKYAQTRPDALTGKELQEMMKANREPKDLKGWLGGFTEWKVLYSLCKDKDGFLHKDTVRAVYHGSLFERLGQERNSKKESSKKK

SEQ ID NO: 500 - DNA, 1130 bp, Zea mays
gcacgagccgatccgtcgttcatcagagtcgtaacgcgctcgttcccctcctagtcgctctcccaagtcccaaccccggttcctttggtctgcgcgaccgagcatggcgtcgccgtcgccgtcgcccgccgtctcgtctctggagacggaggcgccccaggctaccgtcacgagggagcgcaggctcaaccccgacctgcaggagcaccttcccaagccatatctcgcgagggctatggtggcggtggacccggaccatccgaccgggaccgaggggcgcgacccccgcggcatgagcgtgcttcagcagcacgtggctttcttcgaccgcaacggcgacggcgtcgtctacccctgggagactttcaaaggcatgcgagcaatagggtgtgggttctttacatcccttgtcctctcgttcctcatcaacctcgtcatgagttatcccactcagccgggatggctaccctcccttttgctctccgttcatgtaaagaacattcataaggctaaacacgggagtgactccgaaacgtatgacactgaagggaggtttgatccatcaaaattcgacgctatatttagcaagtatggtcgtactcatccagatgcgttgacaaaagatgagatgaactcgatgcttaaggcaaaccgcaatatatatgatttcctcggctggatcgctgctatcggtgaatggcatctactctacagtgtggcaaaggacaaagatggcctgttgcagcgagaaactgtccggggcctgttcgatgcgagtctatttgagcgactgcaggacagcaaaaaatcctcctgatgaatgggccagagaggagttcccaccttaagaagaccgacagtagaaaaatagcatgttataattattgtcctacgtaatttctttaaaaaatgtaatttgagtcgttttcgaataagaaatgtttccatgatgtagtcaatacatattattgtagaactataatggtcatcttgtttatttaatactctcttcgtttcaaaatataattgaccgttttaatataacttgcttgaccgttttaaaaaaaaaaaaaaaaaaaaaaaaaaaaaaaaaaaaaaaaaaaaaaaaaaaaaaaaaaaaaaaaaaaaaa

SEQ ID NO: 501 - protein, 237 aa, Zea mays
MASPSPSPAVSSLETEAPQATVTRERRLNPDLQEHLPKPYLARAMVAVDPDHPTGTEGRDPRGMSVLQQHVAFFDRNGDGVVYPWETFKGMRAIGCGFFTSLVLSFLINLVMSYPTQPGWLPSLLLSVHVKNIHKAKHGSDSETYDTEGRFDPSKFDAIFSKYGRTHPDALTKDEMNSMLKANRNIYDFLGWIAAIGEWHLLYSVAKDKDGLLQRETVRGLFDASLFERLQDSKKSS

SEQ ID NO: 502 - DNA, 1279 bp, Zea mays
tgggccctgtagcagcgtctccggagttctgcggggccgcgcacaagtccagggacgaccactcactatagggatttttgttttttttgttttttttttttttttttaagaagaaccgatccgttaaaataataataaaaaaaacaaaaccgttgcctgccattgagtccgacccactcgctttcttacacagccacacaggcaagcattcagaaacgacaaaaaaaaaacgttgcttgttattgattactgaaattaacgtaaacgaatcagcccttcttcgcctgcgccgccagctggtaaaagagggatccgtcgtacacggccctgacggtgtccttgggtgggcatggtgatcacggcgcggcggctgcgggcgtcgccccggcaggcggcaacggcatgacggagctgcagaagcacgtggcgttcttcgaccgcaaccacgacggcatcatcaccttcgacgagacctaccaaggtctgcaggacgtcggagttggcgatgtcacggccaaagccagcgccgcgttcattaacggcgccctcgggcccaagaccagacctgacaattccaactcctcgcgcatggatatctacgtagagaacattcagaagggcaaacatggaagcgacacaggcgcctacgacgctcaaggaaggttcgttcccgcgaagctggacgagatgttcaccaagcacgccaagaccgtaccgaacgccctgacgaaagacgagctcgacgagatgctcaaggataaccgggagaagatggacgtcgcaggatggctgggagccaagtcggagtgggagatgctgtacaagctggccaaggacaaggacggccgcctgcccaaggacaccgtcagggccgtgtacgacggatccctcttttaccagctggcggcgcaggcgaagaagggctgattcgtttacgttaatttcagtaatcaataacaagcaacgttttttttttgtcgtttctgaatgcttgcctgtgtggctgtgtaagaaagcgagtgggtcggactcaatggcaggcaacggttttgtttttttataaaaaaaaaccaaacacccggagggggggcgcttacacgtccgagtagtttactcagatgccgccgctagtgctgtcgtttaaagtccggacgggaaacctgaggtgcacactaacgcgtgcacaaaccccgttccgcagcggctatagcaatagccgaccgtcgccttccacagtgcgcactggatggaatggaccgcctgtaccggcattagcgtg

SEQ ID NO: 503 - protein, 174 aa, Zea mays
MTELQKHVAFFDRNHDGIITFDETYQGLQDVGVGDVTAKASAAFINGALGPKTRPDNSNSSRMDIYVENIQKGKHGSDTGAYDAQGRFVPAKLDEMFTKHAKTVPNALTKDELDEMLKDNREKMDVAGWLGAKSEWEMLYKLAKDKDGRLPKDTVRAVYDGSLFYQLAAQAKKG

SEQ ID NO: 504 - DNA, 1166 bp, Zea mays
ccacgcgtccggcagcgcatgactttgtatctgcaactcgtttcgactagcctgcacgccgggagcccgcccttctccacctccgaagatcctgcgagttcaacccgcgagtgagcatgtcgtcctactccccgccaccgccgctgccgccgcgggaccagtccatggacaccgaggcacccaacgcgcccatcaccagggagcggaggctcaaccccgatctgcaggagcagctccccaagccatatctcgcgagagctctcgaggcggtggacccgagccacccgcaggggaccaaggggcgcgacccccgcggcatgagcgtgcttcagcagcacgccgccttcttcgaccgcaatggcgacggcgtcatctacccctgggagacgtttcaaggactgcgagcgataggatgtggactcactgtatcattcgcgttctccatactgatcaacctcttcctcagttatcccactcagccgggatggttaccttctcctttgctgtccatccgtatagacaacatccacaagggtaagcacgggagtgattctgaaacttacgacactgaagggaggtttgatccatcaaagttcgatgctatattcagtaagtacggtcgaacccatcctaatgctctaacaagagacgagttgagctcaatgcttcaaggaaaccgcaatacgtacgatttccttggctggttggccgctgccggtgaatggctcttactctacagcttggcgaaagacaaggatggcctcttgcagcgcgaaactgtccgtggtctatttgatgggagcctatttgagcgactggaagacgacaacaacaagaagaaatcgtcctgaatgctgagcagccttgtacagctcagggaagcgctgtcagtacaaaactaccagatataccattggtcgtgttcaaataacaaatgcttcggctttgttcatccgtcattaactatgagtgctgggatttgtttgtatgtgtgtcgtgctaccagtttcttctcctgtcgtctcacacaggtactgtattacgcatgtgttttctagtgtccgtgcggaagctgtattataagctgaaatatgtgcgtttgaaatttactagttaagggtgcgcgccctgcgcgcgtgtattgtatgcttaaaaaaaaaaaaaaa

SEQ ID NO: 505 - protein, 244 aa, Zea mays
MSSYSPPPPLPPRDQSMDTEAPNAPITRERRLNPDLQEQLPKPYLARALEAVDPSHPQGTKGRDPRGMSVLQQHAAFFDRNGDGVIYPWETFQGLRAIGCGLTVSFAFSILINLFLSYPTQPGWLPSPLLSIRIDNIHKGKHGSDSETYDTEGRFDPSKFDAIFSKYGRTHPNALTRDELSSMLQGNRNTYDFLGWLAAAGEWLLLYSLAKDKDGLLQRETVRGLFDGSLFERLEDDNNKKKSS

SEQ ID NO: 506 - DNA, 999 bp, Zea mays
ccacgcgtccgggggccccgtggggagtgggggcacgggcacccgcacaagctgcgctgccagtgccagcgctcacacgaacgccgagacccgagaggagcaaacagccaaaaagaacggaaaggagagagcagttaccttgcgcgcgaagactcgaaggggaatctccggaggatggaggtgggcaggactccgcggcgacgggcgtccccagcggcagcggctgtaccttcgctgcttctgttcgccgtgctatttgtgggtgaagtgggccgggcggcggcagcgttgggtggcccggcgccggcgctgtacaagcacgcgtcgttcttcgaccgcgacggcgacggcgtcgtctccttcgcggagacgtacggcgcgtttcgggccctcgggtttggactcggcctgtccagcgtcagcgccgccttcatcaatggcgcccttggcagcaagtgcagacctcaaaacgcgacgtcgtcgaagctggacatctacatagaggacatccggagagggaagcacgggagcgactccggctcgtacgacgcccaaggaaggttcgttcccgagaagttcgaggagatattcgccaggcacgcgaggactgtccccgacgccctgacctcggacgagatcgaccagctgctccaagcgaacagagagcccggggactacagcggctgggctggcgcggaagcggagtggaagatcctgtacagtctcggcaaggacggggacggcctcctccgcaaggacgtcgcgaggagcgtctacgacgggacactgttccaccggctcgcgcccagatggaaatctcccgacagcgacatggagagaagctgataagcgtggtccgggagaactgaaccgggtctggacatgctgtcaagcgacatgtactggcggtgtgaacgggtgtgaactcactttcgggtcagattattaacaagaagggtgtgaccgtgtgagtgtgaaaaaaaaaaaaaaaaaaaaaaa

SEQ ID NO: 507 - protein, 223 aa, Zea mays
MEVGRTPRRRASPAAAAVPSLLLFAVLFVGEVGRAAAALGGPAPALYKHASFFDRDGDGVVSFAETYGAFRALGFGLGLSSVSAAFINGALGSKCRPQNATSSKLDIYIEDIRRGKHGSDSGSYDAQGRFVPEKFEEIFARHARTVPDALTSDEIDQLLQANREPGDYSGWAGAEAEWKILYSLGKDGDGLLRKDVARSVYDGTLFHRLAPRWKSPDSDMERS

SEQ ID NO: 508 - DNA, 1003 bp, Oryza sativa; identical to SEQ ID NO: 175

SEQ ID NO: 509 - protein, 240 aa, Oryza sativa
MASSSSSSPPSSDPSLETVAPHAAVTGERKLNPNLQEQLPKPYLARALAAVDPSHPQGTRGRDARGMSVLQQHAAFFDRNGDGIIYPWETFQGLRAIGCGYPVSIAGAILINLVLSYPTQPGWMPSPLFSIHIKNIHKGKHGSDSEAYDTEGRFDPSKFDAIFSKYGRTHPNALTKDELNSMIKANRNMYDFIGWITSAGEWMLLYSVAKDKEGLLQRETVRGAFDGSLFERLQDSKKSA

SEQ ID NO: 510 - DNA, 1075 bp, Oryza sativa
gcacgagcaccatcagccaaagtgccaaacgatcgatcgatctctgcagtctgcagattagcccaccacctccagcatcgggtccacgaatgcacaccctgtcaactccactccacccgcttttctttccctctccccgccaccttcacatctcaacctttcctctccctctctctctctctctctgatctcgtcgttcccatggcctccaaacccgcggacgttacggctacaggtggcggcggcgtcgccgtcgtccgtgacaacaacaacaacgccggcggcggcgaggcggaggtgtaccgctccgagctgacgccgctgcagaagcacgtcgccttcttcgaccgcaacaaggacggcatcatctacccctccgagacctaccaagggttccgcgcaatcggggcaggagtcgtgctgtccgccgtcggcgccgtgttcatcaatggcggacttgggcccaagacgataccggagaacaccaagactggtctcaagttacccatatacgtcaagaacatccacaaaggcaagcatggaagcgattcaggcgtgtatgatgcgaatggaaggtttgtcccagaaaagttcgaggaaatattcaagaagcatgctcacaccaggcctgatgccctaacagacaaagagctgaaggagttgctccaatcaaacagggagcctaaagatttcaaaggatggttgggtggcttcacagagtggaaagtattgtactacctctgcaaagacaaggatggatttcttcacaaggatactgtcagggcagtctatgatggaagcctatttgcaaagatggagcaagagaagcagtctgctaagaagaaatgataagaccatactgggtgctgtaattatctgttattgttgcaggtgattgtaaattacggtgtgggtgtgaatccaaaattattgctgtagtttgattgcgcgtgtttgttgacccgttcctgtaacaagaagctatttgtgaagttattggaagtgtttgtaaacatggtggtatcctctgatttattcacttcatttttttcttttaaaaaaaaaaaaaaaaaaa

SEQ ID NO: 511 - protein, 215 aa, Oryza sativa
MASKPADVTATGGGGVAVVRDNNNNAGGGEAEVYRSELTPLQKHVAFFDRNKDGIIYPSETYQGFRAIGAGVVLSAVGAVFINGGLGPKTIPENTKTGLKLPIYVKNIHKGKHGSDSGVYDANGRFVPEKFEEIFKKHAHTRPDALTDKELKELLQSNREPKDFKGWLGGFTEWKVLYYLCKDKDGFLHKDTVRAVYDGSLFAKMEQEKQSAKKK

SEQ ID NO: 512 - DNA, 886 bp, Glycine max
gcacgagaattcattcaccaaaaagttcttcgccccttctttgtccccattctttctctttaatatactttgtccatattttcctctttctcttcctatcaaacatccatggcttccttgtcttctagtacaaaacagagcaataataaccaagaggttgatgagaaaccaataccacacgatcaaaacgttctgcaaaagcacgttgcgttcttcgacaggaaccacgatggcatcatatacccgtgggagactttccaaggatttcgagcaataggttgtgggtacttattatcgtccgttgctgctattttcatcaatggaggtctcagtcagaaaacccgcccgggaaagtttccttcaatactgctaccaattgaagttcaaaacatccatagaagcaagcatggaagtgactctggtgtctacgatagtgaaggaaggtttgttctttcaaaatttgaagaaattttcagcaagcatgctcgaacacacccaaattctttaacatctgatgaattgatggggatgcttgtggcaaatagagttcctaaggattacgctggatggcttgctagctacacggagtggaagatcctatatgttcttggcaaagacaaggatggtttactgcacaaagagactattcgagctgtttatgatggaagcctctttgaaaaaatggaaaaggaacattcagacaagaaagcgaaataaataaagattgacatgaattatataagttgggacatgcgtctttgtgaatttcttgttgagtgccttgaaagtgttatttatggtgtatattcctattggtgtatgaacttaagttacgtattaattgtttaatgcaaatgattttatattaaaaaaaaaaaaaaaaaaa

SEQ ID NO: 513 - protein, 202 aa, Glycine max
MASLSSSTKQSNNNQEVDEKPIPHDQNVLQKHVAFFDRNHDGIIYPWETFQGFRAIGCGYLLSSVAAIFINGGLSQKTRPGKFPSILLPIEVQNIHRSKHGSDSGVYDSEGRFVLSKFEEIFSKHARTHPNSLTSDELMGMLVANRVPKDYAGWLASYTEWKILYVLGKDKDGLLHKETIRAVYDGSLFEKMEKEHSDKKAK

SEQ ID NO: 514 - DNA, 909 bp, Glycine max
gcacgagatttgattccttagttcagcattctattattatatatggcttcttcaccttcctcagaaaacaaaaacctagagggagtagctggtggtgccggagagaaacccattccacttggtgagaacgttctgcagaagcatgctgcattctttgacttgaataaagatggtgtcatctacccatgggagacttttaaagggttgcgtgaaatcgggactggggttttgctgtccgttggaggtgctattttcatcaatgtgtttctcagtcagagtactcgtcccggaaagtttccatctatactttttccaattgaaattaaaaatatccaacgcggcaaacacggcagtgacactggagtctacgatactgaaggaaggtttgtaccttcaaaatttgaagaaatttttaacaagcatgcacatacacatccaaatgctttgacatatgatgagttaacggagatgataaaggcaaatagagagcctaaagatttctcaggaaggattggtagtgtggttgaatggaaaattctttacaaacttgctaaagataagagtggattactgcagaaagaaacaatccgaggtgtttacgatggaagtttatttgaacaactgaaaaaacaacactcttcaggcaaagagaagtagtaatatttttcagacacgtatgtgaaaagaagaagttacttgtcgatctcagcaaaattggttatttttatgaatttatatgctagtaagttagtcacaatattcaaagtgtctgtttatttttatgttcatcaataatgtatatgtcaagtcaaacttatgtgtcatctatcatgtttgaattcatccgaaaagcacgtatacagtaaaataaagaatacaattttataataaaaaaaaaaaaaaaaaaaa

SEQ ID NO: 515 - protein, 204 aa, Glycine max
MASSPSSENKNLEGVAGGAGEKPIPLGENVLQKHAAFFDLNKDGVIYPWETFKGLREIGTGVLLSVGGAIFINVFLSQSTRPGKFPSILFPIEIKNIQRGKHGSDTGVYDTEGRFVPSKFEEIFNKHAHTHPNALTYDELTEMIKANREPKDFSGRIGSVVEWKILYKLAKDKSGLLQKETIRGVYDGSLFEQLKKQHSSGKEK

SEQ ID NO: 516 - DNA, 950 bp, Glycine max
gcacgagcttatagcttcatcccaaaaagctcttttccttctaaatttgattccttagttcagcattctattattatatatggcttcttcaccttcctcagaaaacaaaaacctagagggagtagctggtggtgccggagagaaacccattccacttggtgagaacgttctgcagaagcatgctgcattctttgacttgaataaagatggtgtcatctacccatgggagacttttaaagggttgcgtgaaatcgggactggggttttgctgtccgttggaggtgctattttcatcaatgtgtttctcagtcagagtactcgtcccggaaagtttccatctatactttttccaattgaaattaaaaatatccaacgcggcaaacacggcagtgacactggagtctacgatactgaaggaaggtttgtaccttcaaaatttgaagaaatttttaacaagcatgcacatacacatccaaatgctttgacatatgatgagttaacggagatgataaaggcaaatagagagcctaaagatttctcaggaaggattggtagtgtggttgaatggaaaattctttacaaacttgctaaagataagagtggattactgcagaaagaaacaatccgaggtgtttacgatggaagtttatttgaacaactgaaaaaacaacactcttcaggcaaagagaagtagtaatatttttcagacacgtatgtgaaaagaagaagttacttgtcgatctcagcaaaattggttatttttatgaatttatatgctagtaagttagtcacaatattcaaagtgtctgtttatttttatgttcatcaataatgtatatgtcaagtcaaacttatgtgtcatctatcatgtttgaattcatccgaaaagcacgtatacagtaaaataaagaatacaattttataataaaaaaaaaaaaaaaaaaaaaaaa

SEQ ID NO: 517 - protein, 204 aa, Glycine max; identical to SEQ ID NO: 515

SEQ ID NO: 518 - DNA, 904 bp, Glycine max; identical to SEQ ID NO: 189

SEQ ID NO: 519 - protein, 201 aa, Glycine max
MASSESTKQEGVVGGIGEKLIPLHENVLQKHAAFFDKNHDGVIYPWETFQGLREIGNGILSSVGLSLFINLALSQTTRPGKFPSLLFPIEIKNIQLGKHGSDTGAYDTEGRFVPSKFEGIFTKHSHTHPNALTYDELKEMLKANREPKDFKGRIGGLVEWKVLYKLAKDKNGLLQKETIRSVYDGSLFEMLKKENSARKKN

SEQ ID NO: 520 - DNA, 867 bp, Glycine max
gcacaattctaattcattcaccaaaaagttcttcgccccttctttgtccccattctttctctttaatatactttgtccatattttcctctttctcttcctatcaaacatccatgacttccttgtcttctagtacaaaacagagcaataataaccaagaggttgatgagaaaccaataccacacgatcaaaacgttctgcaaaagcacgttgcgttcttcgacaggaaccacgatggcatcatatacccgtgggagactttccaaggatttcgagcaataggttgtgggtacttattatcgtccgttgctgctattttcatcaatggaggtctcagtcagaaaacccgcccgggaaagtttccttcaatactgctaccaattgaagttcaaaacatccatagaagcaagcatggaagtgactctggtgtctacgatagtgaaggaaggtttgttctttcaaaatttgaagaaattttcagcaagcatgctcgaacacacccaaattctttaacatctgatgaattgatggggatgcttgtggcaaatagagttcctaaggattacgctggatggcttgctagctacacggagtggaagatcctatatgttcttggcaaagacaaggatggtttactgcacaaagagactattcgagctgtttatgatggaagcctctttgaaaaaatggaaaaggaacactcagacaagaaagcgaaataaataaagattgacatgaattatataagttgggacatgcgtctttgtgaatttcttgttgagtgccttgaaagtgttatttatggtgtatattcctattggtgtatgaacttaagttacgtattaattgtttaatgcaaatgattttat

SEQ ID NO: 521 - protein, 202 aa, Glycine max
MTSLSSSTKQSNNNQEVDEKPIPHDQNVLQKHVAFFDRNHDGIIYPWETFQGFRAIGCGYLLSSVAAIFINGGLSQKTRPGKFPSILLPIEVQNIHRSKHGSDSGVYDSEGRFVLSKFEEIFSKHARTHPNSLTSDELMGMLVANRVPKDYAGWLASYTEWKILYVLGKDKDGLLHKETIRAVYDGSLFEKMEKEHSDKKAK

SEQ ID NO: 522 - DNA, 911 bp, Triticum aestivum
gcaagaggcacagtgtgatacgcagagatagcgatcgagccgagcgccatggccgaggaggcaacaagggcggtcagggaagaagagctgtcgccggtggcggagggggcgcccgtgacggcccggcggcccgtccgagcggacctggagaagcgcatcccgaagccctacctggcccgagccctggtggcgccggacgtgtaccatcccggagggagcaaggagggcgggcaccagcaccgccagaggagcgtgctgcagcagcacgtcgccttcttcgacatggatggcgacggcgtcatctatccatgggaaacttaccaaggactgagggcattgggcttcaacatgatcgtctccatcctcatcgcaataggcatacatactaccctgagctacacaactctgcatagctgggtgccatctctccttttcccaatctacatcgacaacatccacagggccaagcatgggagcgacaccgcgacttatgactccgagggaaggtacatgccggtgaacttcgagaacatattcagcaagaacgcctcgccggataagctcacattccgggaaatctggatgatgaccgacggccaacggcaggcgaacgacccatttggatgggtggcgagcaagggggagtggatgctgctgtacatgctcgccaaggacgaggaggggaaccttccgagggaggctattcgccgctgcttcgacggtagcctcttcgagttcatcgccgacgagaggaggcaggcacacgggaagcggcagtagcatgcaacgcctgccggcccggaacgtcttcatgtgtattgtgtaagactgtggactagctaccgcctcatgtattcctaccatgaagtaataagttgtgccctcctcaaaaaaaaaaaaaaaaaaaaaaa

SEQ ID NO: 523 - protein, 243 aa, Triticum aestivum
MAEEATRAVREEELSPVAEGAPVTARRPVRADLEKRIPKPYLARALVAPDVYHPGGSKEGGHQHRQRSVLQQHVAFFDMDGDGVIYPWETYQGLRALGFNMIVSILIAIGIHTTLSYTTLHSWVPSLLFPIYIDNIHRAKHGSDTATYDSEGRYMPVNFENIFSKNASPDKLTFREIWMMTDGQRQANDPFGWVASKGEWMLLYMLAKDEEGNLPREAIRRCFDGSLFEFIADERRQAHGKRQ

SEQ ID NO: 524 - DNA, 941 bp, Triticum aestivum
gcacgaggatccatccgcaacgcacggtgtgatacagagagagcgatcgagccgagcgtcatggcggaggaggcaagggcggtcagggaagaagagctgtcgccggtggcggaggcggcgcccgtgacggcccggcgacccgtccgagcggacctggagaagcacatcccgaagccctacctggcccgagccctggtggcgccggacgtgtaccatcccggagggagcaaggagggcgggcaccagcaccgccagaggagcgtgctgcagcaacacgtcgccttcttcgacatggatggcgacggcgtcatctatccatgggaaacttaccaaggactgagggcactgggcttcaacatgatcgtctccgtcgtcttcgcaatggccattcatgctagcctcagctacacaactctgcatagctgggtaccatctctgctgttcccgatctacatcgacaacatccacagggccaagcatggcagcgacaccgcgacttatgacaccgagggaaggtacataccggtgaacttcgagaacatattcagcaagaacgcccgctcgtcgccggataagctcacattccgggagatctggatgatggccgagggccaacggcaggcgaacgatccattcggatgggtggcgagcaaggcggagtggatgctgctgtacatgctcgccaaggatgaggaggggaaccttccgagggaggctattcgccgctgcttcgacggtagtctcttcgagttcatcgccgacgagaggaggcaggcacacgggaagcggcagtagcatgcaacgctgtcggcccggaatgtcttcctgtctaagactgtggactagctaccgcctcatgtattcctaccatgaaataataagttgtgcccagtttcatcaggaaaagaaacacagtcgttttcaatgttgattttaaaaaa

SEQ ID NO: 525 - protein, 244 aa, Triticum aestivum
MAEEARAVREEELSPVAEAAPVTARRPVRADLEKHIPKPYLARALVAPDVYHPGGSKEGGHQHRQRSVLQQHVAFFDMDGDGVIYPWETYQGLRALGFNMIVSVVFAMAIHASLSYTTLHSWVPSLLFPIYIDNIHRAKHGSDTATYDTEGRYIPVNFENIFSKNARSSPDKLTFREIWMMAEGQRQANDPFGWVASKAEWMLLYMLAKDEEGNLPREAIRRCFDGSLFEFIADERRQAHGKRQ

SEQ ID NO: 526 - DNA, 1157 bp, Triticum aestivum; identical to SEQ ID NO: 197

SEQ ID NO: 527 - protein, 234 aa, Triticum aestivum
MSSSSSDPSLATEAPQAAVTSERKLNRDLQEQLAKPYLARAMAAVDPSHPEGSKGRDTKGMSVLQQHAAFFDRNGDGVIYPWETFQSLRAIGLGSPSAFGTSILLHLVLTYPTQPGWMPSPLLSIHIKNIHRGKHGSDSETYDTEGRFEPAKFDAIFSKFGKTRPNALSEDEINAMLKYNRNMYDFLGWAAANLEWKLLHKVAKDNEGFLQREIVRGAFDGSLFERLQESKKST

SEQ ID NO: 528 - protein, 345 aa, Arabidopsis thaliana
  misc_feature: gi 18394319
MFIAVEVSPVMEDITRQSKKTSVENETGDDQSATSVVLKAKRKRRSQPRDAPPQRSSVHRGVTRHRWTGRYEAHLWDKNSWNETQTKKGRQVYLGAYDEEDAAARAYDLAALKYWGRDTILNFPLCNYEEDIKEMESQSKEEYIGSLRRKSSGFSRGVSKYRGVAKHHHNGRWEARIGRVFGNKYLYLGTYATQEEAAIAYDIAAIEYRGLNAVTNFDISRYLKLPVPENPIDTANNLLESPHSDLSPFIKPNHESDLSQSQSSSEDNDDRKTKLLKSSPLVAEEVIGPSTPPEIAPPRRSFPEDIQTYFGCQNSGKLTAEEDDVIFGDLDSFLTPDFYSELNDC

SEQ ID NO: 529 - protein, 566 aa, Arabidopsis thaliana
  misc_feature: gi 15238174
MEMLRSSDQSQFVSYDASSAASSSPYLLDNFYGWSNQKPQEFFKEEAQLAAAASMADSTILTTFVDPQSHHSQNHIPKLEDFLGDSSSIVRYSDNSQTDTQDSSLTQIYDPRHHHNQTGFYSDHHDFKTMAGFQSAFSTNSGSEVDDSASIGRTHLAGDYLGHVVESSGPELGFHGGSTGALSLGVNVNNNTNHRNDNDNHYRGNNNGERINNNNNNDNEKTDSEKEKAVVAVETSDCSNKKIADTFGQRTSIYRGVTRHRWTGRYEAHLWDNSCRREGQARKGRQGGYDKEDKAARAYDLAALKYWNATATTNFPITNYSKEVEEMKHMTKQEFIASLRRKSSGFSRGASIYRGVTRHHQQGRWQARIGRVAGNKDLYLGTFATEEEAAEAYDIAAIKFRGINAVTNFEMNRYDVEAIMKSALPIGGAAKRLKLSLEAAASSEQKPILGHHQLHHFQQQQQQQQLQLQSSPNHSSINFALCPNSAVQSQQIIPCGIPFEAAALYHHHQQQQQHQQQQQQQNFFQHFPANAASDSTGSNNNSNVQGTMGLMAPNPAEFFLWPNQSY

SEQ ID NO: 530 - protein, 692 aa, Oryza sativa
  misc_feature: gi 20161013
MATMNNWLAFSLSPQDQLPPSQTNSTLISAAATTTTAGDSSTGDVCFNIPQDWSMRGSELSALVAEPKLEDFLGGISFSEQQHHHGGKGGVIPSSAAACYASSGSSVGYLYPPPSSSSLQFADSVMVATSSPVVAHDGVSGGGMVSAAAAAAASGNGGIGLSMIKNWLRSQPAPQPAQALSLSMNMAGTTTAQGGGAMALLAGAGERGRTTPASESLSTSAHGATTATMAGGRKEINEEGSGSAGAVVAVGSESGGSGAVVEAGAAAAAARKSVDTFGQRTSIYRGVTRHRWTGRYEAHLWDNSCRREGQTRKGRQGGYDKEEKAARAYDLAALKYWGPTTTTNFPVNNYEKELEEMKHMTRQEFVASLRRKSSGFSRGASIYRGVTRHHQHGRWQARIGRVAGNKDLYLGTFSTQEEAAEAYDIAAIKFRGLNAVTNFDMSRYDVKSILDSAALPVGTAAKRLKDAEAAAAYDVGRIASHLGGDGAYAAHYGHHHHSAAAAWPTIAFQAAAAPPPHAAGLYHPYAQPLRGWCKQEQDHAVIAAAHSLQDLHHLNLGAAAAAHDFFSQAMQQQHGLGSIDNASLEHSTGSNSVVYNGDNGGGGGGYIMAPMSAVSATATAVASSHDHGGDGGKQVQMGYDSYLVGADAYGGGGAGRMPSWAMTPASAPAATSSSDMTGVCHGAQLFSVWNDT

SEQ ID NO: 531 - protein, 244 aa, Oryza sativa [sequence omitted]

SEQ ID NO: 532 - protein, 236 aa, Arabidopsis thaliana; identical to SEQ ID NO: 393
  misc_feature: gi 2459421

What is claimed is:

1. An isolated nucleic acid comprising: a nucleic acid sequence encoding a polypeptide of SEQ ID NO: 320.

2. The nucleic acid of claim 1 that comprises the sequence of SEQ ID NO: 319.

3. A chimeric construct comprising the isolated nucleic acid of claim 1 operably linked to at least one regulatory sequence.

4. A plant comprising in its genome the chimeric construct of claim 3.

5. The plant of claim 4 wherein said plant is selected from the group consisting of corn, soybean, wheat, rice, canola, Brassica, sorghum, sunflower, and coconut.

6. Seeds obtained from the plant of claim 4.

7. A method for altering an oil phenotype in a plant which comprises:
(a) transforming a plant with the chimeric construct of claim 3;
(b) growing the transformed plant under conditions suitable for expression of the chimeric gene; and
(c) selecting those transformed plants whose oil phenotype has been altered compared to the oil phenotype of an untransformed plant.

* * * * *

UNITED STATES PATENT AND TRADEMARK OFFICE
CERTIFICATE OF CORRECTION

| | |
|---|---|
| PATENT NO. | : 7,157,621 B2 |
| APPLICATION NO. | : 10/183687 |
| DATED | : January 2, 2007 |
| INVENTOR(S) | : Allen et al. |

It is certified that error appears in the above-identified patent and that said Letters Patent is hereby corrected as shown below:

Title Page,
Item (75) Inventors, should read as follows:
-- (75) Inventors:   William B. Allen, Urbandale, IA (US);
Rebecca E. Cahoon, Webster Groves, MO (US);
Sabine Epelbaum, Wilmington, DE (US);
Igor Cunha Oliveira, Urbandale, IA (US);
Bo Shen, Johnston, IA (US);
Mitchell C. Tarczynski, West Des Moines, IA (US) --

Signed and Sealed this

Third Day of April, 2007

JON W. DUDAS
*Director of the United States Patent and Trademark Office*